United States Patent 12,508,308 (INFLUENZA mRNA VACCINES) - sequence listing, part 15

SEQ ID NO: 56180 - RNA, 1410 nt, Artificial Sequence
  neuraminidase__InfluenzaA__AIL94392
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaauuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56181 - RNA, 1410 nt, Artificial Sequence
  neuraminidase__InfluenzaA__AIL94403
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcguuauuacuuaugaaaacaacacuuggguaaaucagacauauguuaacaucagcaacaccaauuuugcugcuggacagucagugguuuccgugaaauuagcgggcaauuccucccucugcccuguuaguggaugggccauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugauccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56182 - RNA, 1410 nt, Artificial Sequence; identical to SEQ ID NO: 56138
  neuraminidase__InfluenzaA__AIL94426

SEQ ID NO: 56183 - RNA, 1410 nt, Artificial Sequence
  neuraminidase__InfluenzaA__AIL94438
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaacuuugcuacuggacagucagugguuuccgugaaauuagcgggcaauuccucucucugcccuguuaguggaugggcuauauacaguaaagacaacaguguaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucugucgcuuggucagcaagugcuugucaugauggcaucaauuggcuaacaauuggaauuucuggcccagacaguggggcaguggcuguuuuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcguuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56184 - RNA, 1410 nt, Artificial Sequence
  neuraminidase__InfluenzaA__AIL94449
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcaaaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggauccaaucggcccaucguagauauaaacauaaaggaucauagcauuguuuacaguuauguguguucaggacuuguuggagacacacccagaaaaaacgacagcuccagcaguagccauuguuugaauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56185 - RNA, 1410 nt, Artificial Sequence; identical to SEQ ID NO: 56179
  neuraminidase__InfluenzaA__AIL94461

SEQ ID NO: 56186 - RNA, 1410 nt, Artificial Sequence
  neuraminidase__InfluenzaA__AIL94473
augaauccaaaccaaaagauaauaaccauugguucggucuguaugacaauuggaauggcuaacuuaauauuacaaauuggaaacauaaucucaauauggguuggccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaauaccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccugaacuaacagggcuggauuguauaagaccuugcuucuggguugaacuaaucagagggcgacccgaagagaacacaaucuggacuagcgggagcagcauauccuuuugugguguaaacagugacauuguggguuggucuuggccagacggugcugaguugccauuuaccauugacaaguaa

SEQ ID NO: 56187 - RNA, 1410 nt, Artificial Sequence
  neuraminidase__InfluenzaA__AIL94484
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgacccugacaaguguuaucaauuugcccuuggacagggaacaacacuaaacaacgugcauucaaauaacacagcacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56188 - RNA, 1410 nt, Artificial Sequence
  neuraminidase__InfluenzaA__AIL94507
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaacuuugcuacuggacagucagugguuuccgugaaauuagcgggcaauuccucucucuguccuguuaguggaugggcuauauacaguaaagacaacaguguaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauauggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56189 - RNA, 1410 nt, Artificial Sequence
  neuraminidase__InfluenzaA__AIL94518
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaagcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucagucucaugccuauauaa

SEQ ID NO: 56190 - RNA, 1410 nt, Artificial Sequence
  neuraminidase__InfluenzaA__AIL94530
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcgucuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuugaauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56191 - RNA, 1410 nt, Artificial Sequence
  neuraminidase__InfluenzaA__AIL94542
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaauuuugcugcuggacagucagugguuuccgugaaauuagcgggcaauuccucccucugcccuguuaguggaugggccauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56192 - RNA, 1410 nt, Artificial Sequence; identical to SEQ ID NO: 56150
  neuraminidase__InfluenzaA__AIL94553

SEQ ID NO: 56193 - RNA, 1410 nt, Artificial Sequence; identical to SEQ ID NO: 56176
  neuraminidase__InfluenzaA__AIL94564

SEQ ID NO: 56194 - RNA, 1410 nt, Artificial Sequence; identical to SEQ ID NO: 56169
  neuraminidase__InfluenzaA__AIL94576

SEQ ID NO: 56195 - RNA, 1410 nt, Artificial Sequence
  neuraminidase__InfluenzaA__AIL94587
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaauuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaauggaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggaaugggacagacaauaacuucucaauaaagcaagauaucguuggaauaaaugaguggucaggauauagcgggaguuuuguucagcauccagaacuaacagggcuggauuguauaagaccuugcuucuggguugaacuaaucagagggcgacccaaagagaacacaaucuggacuggcgggagcagcauauccuuuugugguguaaacagugacacuguggguuggucuuggccagacggugcugaguugccauuuaccauugacaaguaa

SEQ ID NO: 56196 - RNA, 1410 nt, Artificial Sequence
  neuraminidase__InfluenzaA__AIL94598
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaauuuugcugcuggacagucagugguuuccgugaaauuagcgggcaauuccucccucugcccuguuaguggaugggccauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaguaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56197 - RNA, 1410 nt, Artificial Sequence
  neuraminidase__InfluenzaA__AIL94609
augaauccaaaucaaaagauaauaacgauuggcucuguuucucucaccauuuccacaauaugccucuucaugcaaauugccaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugagugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucuauauccuggugucagaugugucugcagagacaacuggaaaggcuccaaucggcccaucguagauauaaacauaaaggaucauagcauuguuuccaguuauguuuguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56198 - RNA, 1410 nt, Artificial Sequence
  neuraminidase__InfluenzaA__AIL94621
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaauuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaaugacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56199 - RNA, 1410 nt, Artificial Sequence; identical to SEQ ID NO: 56150
  neuraminidase__InfluenzaA__AIL94632

SEQ ID NO: 56200 - RNA, 1410 nt, Artificial Sequence; identical to SEQ ID NO: 56138
  neuraminidase__InfluenzaA__AIL94643

SEQ ID NO: 56201 - RNA, 1410 nt, Artificial Sequence
  neuraminidase__InfluenzaA__AIL94655
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaccgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgaccuaaagagaacacaaucuggacuagcgggagcagcauauccuuuugugguguaaacagugacacuguggguuggucuuggccagacggugcugaguugccauuuaccauugacaaguaa

SEQ ID NO: 56202 - RNA, 1410 nt, Artificial Sequence
  neuraminidase__InfluenzaA__AIL94677
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaauuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56203 - RNA, 1410 nt, Artificial Sequence
  neuraminidase__InfluenzaA__AIL94688
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaagcaagucauaguugacagaggcgauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56204 - RNA, 1410 nt, Artificial Sequence
  neuraminidase__InfluenzaA__AIL94700
augaauccaaaucaaaagauaauaacgauuggcucuguuucucucaccauuuccacaauaugcuucuucaugcaaauugccaucuugauaacuauuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauauuagcacauugucaggaagugcucagcaugucgaagagugcucuugcuauccucgauauccuggugucagaugugucugcagagacaacuggaaaggauccaaucggcccaucguagauauaaacauagaggaucauagcauuguuuccaguuauguguguucaggacuuguuggagacacacccagaaaaaacgacagcuccagcaguagccauuguuuggauccuaacaaugaagaggguggucauggagugaaaggcugggcauuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggagcggaccucaaucucaugccuauauaa

SEQ ID NO: 56205 - RNA, 1410 nt, Artificial Sequence; identical to SEQ ID NO: 56169
  neuraminidase__InfluenzaA__AIL94712

SEQ ID NO: 56206 - RNA, 1410 nt, Artificial Sequence; identical to SEQ ID NO: 56191
  neuraminidase__InfluenzaA__AIL94723

SEQ ID NO: 56207 - RNA, 1410 nt, Artificial Sequence
  neuraminidase__InfluenzaA__AIL94734
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgagcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauauuagcacauugucaggaagugcucagcaugucgaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaagaggguggucauggagugaaaggcugggcauuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56208 - RNA, 1410 nt, Artificial Sequence; identical to SEQ ID NO: 56150
  neuraminidase__InfluenzaA__AIL94746

SEQ ID NO: 56209 - RNA, 1410 nt, Artificial Sequence; identical to SEQ ID NO: 56180
  neuraminidase__InfluenzaA__AIL94757

SEQ ID NO: 56210 - RNA, 1410 nt, Artificial Sequence; identical to SEQ ID NO: 56142
  neuraminidase__InfluenzaA__AIL94768

SEQ ID NO: 56211 - RNA, 1410 nt, Artificial Sequence; identical to SEQ ID NO: 56138
  neuraminidase__InfluenzaA__AIL94780

SEQ ID NO: 56212 - RNA, 1410 nt, Artificial Sequence; identical to SEQ ID NO: 56180
  neuraminidase__InfluenzaA__AIL94803

SEQ ID NO: 56213 - RNA, 1410 nt, Artificial Sequence; identical to SEQ ID NO: 56160
  neuraminidase__InfluenzaA__AIL94814

SEQ ID NO: 56214 - RNA, 1410 nt, Artificial Sequence
  neuraminidase__InfluenzaA__AIL94826
augaauccaaaucaaaagauaauaacgauuggcucuguuucucucaccauuuccacaauaugcuucuucaugcaaauugccaucuugauaacuacuguaacauugcauuucaagcaauaugaauucaacucccucccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacagcacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuugaauccuaacaaugaagaagguggucauggagugaaaggcugggccuuugaugauggaaacgacguauggaugggaagaacaaucaacgagacaucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56215 - RNA, 1410 nt, Artificial Sequence
  neuraminidase__InfluenzaA__AIL94850
augaauccaaaucaaaagauaauaacgauuggcucuguuucucucaccauuuccacaauaugcuucuucaugcaaauugccaucuugauaacuacuguuacauugcauuucaagcaauaugaauucaacucccccccaaacaaccaagugaugcuguuugaaccaacaauaauagaaagaaacauaacagagauaguguaucugaccaacaccaccauagagaaggaaauaugccccaaacuagcagaauauagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguauuguuucaugguccaaagaaauccucaggacccaggagucagaaugcguuuguaucaauggaacuuguacaguaguaaugacugaugggagugcuucaggaaaagcugauacuaaaauacuauucauuaaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacagugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauuucagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggaccucaaucucaugccuauauaa

SEQ ID NO: 56216 - RNA, 1410 nt, Artificial Sequence; identical to SEQ ID NO: 49914
  neuraminidase__InfluenzaA__AIL94862

SEQ ID NO: 56217 - RNA, 1410 nt, Artificial Sequence
  neuraminidase__InfluenzaA__AIL94874
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaaccccaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56218 - RNA, 1410 nt, Artificial Sequence
  neuraminidase__InfluenzaA__AIL94886
augaauccaaaccaaaagauaauaaccauugguucggucuguaugacaauuggaauggcuaacuuaauguuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucaguggucuccgugaaaauagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacgauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccucaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56219 - RNA, 1410 nt, Artificial Sequence; identical to SEQ ID NO: 55719
  neuraminidase__InfluenzaA__AIL94897

SEQ ID NO: 56220 - RNA, 1410 nt, Artificial Sequence; identical to SEQ ID NO: 56214
  neuraminidase__InfluenzaA__AIL94909

SEQ ID NO: 56221 - RNA, 1410 nt, Artificial Sequence; identical to SEQ ID NO: 56138
  neuraminidase__InfluenzaA__AIL94921

SEQ ID NO: 56222 - RNA, 1410 nt, Artificial Sequence; identical to SEQ ID NO: 56138
  neuraminidase__InfluenzaA__AIL94933

SEQ ID NO: 56223 - RNA, 1410 nt, Artificial Sequence; identical to SEQ ID NO: 56142
  neuraminidase__InfluenzaA__AIL94945

SEQ ID NO: 56224 - RNA, 1410 nt, Artificial Sequence
  neuraminidase__InfluenzaA__AIL94957
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaagcgucauuacuuaugaaaacaacacuuggguaaaucagacauauguuaacaucagcaacaccaauuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaauggaugccccuaauuaucacuaugaggaaugcuccuguuauccugauucuagugaaaucacaugugugugcagggauaacuggcauggcucgaaucgaccgugggugucuuucaaccagaaucuggaauaccagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggaaugggacagacaauaacuucucaauaaagcaagauaucguuggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56225 - RNA, 1410 nt, Artificial Sequence; identical to SEQ ID NO: 56214
  neuraminidase__InfluenzaA__AIL94968

SEQ ID NO: 56226 - RNA, 1410 nt, Artificial Sequence
  neuraminidase__InfluenzaA__AIM55840
augaauccaaaccaaaagauaauaaccauugguucggucuguaugacaauuggaauggcuaacuuaauauuacaaauuggaaacauaaucucaauauggauuagucacucaauucaaguugggaaucaaagucagauugaaauaugcaaucaaagcgucauuacuuaugaaaacaacacuuggguaaaucagacauauguuaacaucagcaacaccaacuuugcugcugggcagccagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaacggcauaauaacagacacuaucaagaguuggagaaacgauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuuugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucaucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccugaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 56227 - RNA, 1410 nt, Artificial Sequence
  neuraminidase__InfluenzaA__AIM55851
augaauccaaaccaaaagauaauaaccauugguucggucuguaugacaauuggaauggcuaacuuaauauuacaaauuggaaacauaaucucaauauggguuagucacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaacuuucuucuugacucaaggggccuugcuaaaugacaaacauuccaauggaaccauuaaagauaggagcccauaucgaacccuaaugagcuguccuauuggugaaguucccucuccauacaacucaagauuugaaucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaggauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaaaagugacacuguggguuggucuuggccagacggugcugaguugccauuuaccauugacaaguaa

SEQ ID NO: 56228 - RNA, 1410 nt, Artificial Sequence
  neuraminidase__InfluenzaA__AIM55862
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggaaugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56229 - RNA, 1410 nt, Artificial Sequence
  neuraminidase__InfluenzaA__AIM55873
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaagcauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56230 - RNA, 1410 nt, Artificial Sequence; identical to SEQ ID NO: 56229
  neuraminidase__InfluenzaA__AIM55884

SEQ ID NO: 56231 - RNA, 1410 nt, Artificial Sequence
  neuraminidase__InfluenzaA__AIM55918
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56232 - RNA, 1410 nt, Artificial Sequence
  neuraminidase__InfluenzaA__AIM55929
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuacuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56233 - RNA, 1410 nt, Artificial Sequence
  neuraminidase__InfluenzaA__AIM55940
augaauccaaaccaaaagauaauaaccauugguucggucuguaugacaauuggaauggcuaacuuaauauuacaaauuggaaacauaaucucuauauggguuagccacucaauucaacuugggaaucaaagucagauugaaacaugcaaucaaagcgucauuacuuaugaaaacaacacuuggguaaaucagacauauguuaacaucagcagcaccaacuuugcugcuggacagucagugguuccugugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56234 - RNA, 1410 nt, Artificial Sequence
  neuraminidase__InfluenzaA__AIM55965
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaagcauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcggcccgaagagaacacaaucuggacuagcgggagcagcauauccuuuugugguguaaacagugacgcuguggguuggucuuggccagacggugcugaguugccauuuaccauugacaaguaa

SEQ ID NO: 56235 - RNA, 1410 nt, Artificial Sequence
  neuraminidase__InfluenzaA__AIM55976
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56236 - RNA, 1410 nt, Artificial Sequence
  neuraminidase__InfluenzaA__AIM55987
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuacuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggauuggucuuggccagacggugcugaguugccauuuaccauugacaaguaa

SEQ ID NO: 56237 - RNA, 1410 nt, Artificial Sequence
  neuraminidase__InfluenzaA__AIM55998
augaauccaaaccaaaagauaauaaccauugguucggucuguaugacaauuggaauggccaacuuaauauuacaaauuggaaacacaaucucaauauggguuagucacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaacuuucuucuugacucaaggggccuugcuaaaugacaaacauuccaauggaaccauuaaagacaggagcccauaucgaacccuaaugagcuguccuauuggugaaguucccucuccauacaacucaagauuugaaucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaaaagugacacuguggguuggucuuggccagacggugcugaguugccauuuaccauugacaaguaa

SEQ ID NO: 56238 - RNA, 1410 nt, Artificial Sequence; identical to SEQ ID NO: 56235
  neuraminidase__InfluenzaA__AIM56009

SEQ ID NO: 56239 - RNA, 1410 nt, Artificial Sequence; identical to SEQ ID NO: 56235
  neuraminidase__InfluenzaA__AIM56020

SEQ ID NO: 56240 - RNA, 1410 nt, Artificial Sequence
  neuraminidase__InfluenzaA__AIM56031
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucaucacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56241 - RNA, 1410 nt, Artificial Sequence
  neuraminidase__InfluenzaA__AIM56042
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacuggaacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56242 - RNA, 1410 nt, Artificial Sequence
  neuraminidase__InfluenzaA__AIM56053
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugaugaacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56243 - RNA, 1410 nt, Artificial Sequence
  neuraminidase__InfluenzaA__AIM56064
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaagcauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuggucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56244 - RNA, 1410 nt, Artificial Sequence
  neuraminidase__InfluenzaA__AIM56086
augaauccaaaccaaaagauaauaaccauugguucggucuguaugacaauuggaauggcuaacuuaauauuacaaauuggaaacauaaucucaauauggguuagccacucaauucaacuugggaaucaaagucauauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaacgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucauaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56245 - RNA, 1410 nt, Artificial Sequence
  neuraminidase__InfluenzaA__AIM56097
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccugaugagcuguccuauuggugaaguucccucuccauacaacucaagauuugagucagucgcuuggucagcaagugcuugccaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucaguugaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcaguggggucuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56246 - RNA, 1410 nt, Artificial Sequence
  neuraminidase__InfluenzaA__AIM56108
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggauaaaucagacauauguuaauaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaagcauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugagaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuuuuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56247 - RNA, 1410 nt, Artificial Sequence
  neuraminidase__InfluenzaA__AIM56119
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaacuuacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56248 - RNA, 1410 nt, Artificial Sequence
  neuraminidase__InfluenzaA__AIM56130
augaauccaaaccaaaagauaauaaccauugguucggucuguaugacaauuggaauggcuaacuuaauauuacaaauuggaaacauaaucucaauauggguuagucacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaacuuucuucuugacucaaggggccuugcuaaaugacaaacauuccaauggaaccauuaaagacaggagcccauaucgaacccuaaugagcuguccuauuggugaaguucccucuccauacaacucaagauuugaaucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaaaagugacacuguggguuggucuuggccagacggugcugaguugccauuuaccauugacaaguaa

SEQ ID NO: 56249 - RNA, 1410 nt, Artificial Sequence
  neuraminidase__InfluenzaA__AIM56141
augaauccaaaccaaaagauaauaaccauugguucgguauguaugacaauuggaauggcuaacuuaauauuacaaauuggaaacauaaucucaauauggguuagccacucaauucaacuugggaaucaaagucagauugaaacaugcaaucaaagcgucauuauuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56250 - RNA, 1410 nt, Artificial Sequence; identical to SEQ ID NO: 56235
  neuraminidase__InfluenzaA__AIM56152

SEQ ID NO: 56251 - RNA, 1410 nt, Artificial Sequence
  neuraminidase__InfluenzaA__AIM56163
augaauccaaaccaaaagauaauaaccauugguucggucuguaugacaauuggaauggcuaacuuaauauuacaaauuggaaacauaaucucaauauggguuagccacucaauucaacuugggaaucaaagucauauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaacgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56252 - RNA, 1410 nt, Artificial Sequence
  neuraminidase__InfluenzaA__AIM56174
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaagcauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccguugacaaguaa

SEQ ID NO: 56253 - RNA, 1410 nt, Artificial Sequence; identical to SEQ ID NO: 56248
  neuraminidase__InfluenzaA__AIM56185

SEQ ID NO: 56254 - RNA, 1410 nt, Artificial Sequence
  neuraminidase__InfluenzaA__AIM56196
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56255 - RNA, 1410 nt, Artificial Sequence
  neuraminidase__InfluenzaA__AIM56207
augaauccaaaccaaaagauaauaaccauugguucggucuguaugacaauuggaauggcuaacuuaauauuacaaauuggaaacauaaucucaauaugggucagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaagcauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcggcccgaagagaacacaaucuggacuagcgggagcagcauauccuuuugugguguaaacagugacacuguggguuggucuuggccagacggugcugaguugccauuuaccauugacaaguaa

SEQ ID NO: 56256 - RNA, 1410 nt, Artificial Sequence
  neuraminidase__InfluenzaA__AIM56229
augaauccaaaccaaaagauaauaaccauugguucggucuguaugacaauuggaauggcuaacuuaauauuacaaauuggaaacacaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauauaacucaagauuugagucagucgcuuggucagcaagugcuugucaugauggcaucaauuggcuuacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaugccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaauuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56257 - RNA, 1410 nt, Artificial Sequence
  neuraminidase__InfluenzaA__AIM56240
augaauccaaaccaaaagauaauaaccauugguucggucuguaugacaauuggaauggcuaacuuaauauuacaaauuggaaacauaaucucaauauggauuagccacucaauucaaguugggaaucaaagucagaucgaaacaugcaaucaaagcgucauuacuuaugaaaacaacacuuggguaaaucagacauauguuaacaucagcaacaccaacuuugcugcugggcagccagugguuuccgugaaauuagcgggcaauuccucucucugcucuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaacggcauaauaacagacacuaucaagaguuggagaaacgauauauugagaacacaagagucugaaugugcauguguaaaugguucuugcuuuaccauaaugaccgauggaccaagugauggacaagccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacgguggguuggucuuggccagacggugcugaguugccauuuaccauugacaaguaa

SEQ ID NO: 56258 - RNA, 1410 nt, Artificial Sequence
  neuraminidase__InfluenzaA__AIM56251
augaauccaaaccaaaagauaauaaccauugguucggucuguaugacaauuggaauggcuaacuuaauauuacaaauuggaaacauaaucucaauauggguuagccacucaauucaacuugggaaucaaagucauauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56259 - RNA, 1410 nt, Artificial Sequence; identical to SEQ ID NO: 56258
  neuraminidase__InfluenzaA__AIM56262

SEQ ID NO: 56260 - RNA, 1410 nt, Artificial Sequence
  neuraminidase__InfluenzaA__AIM56273
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuucgcugcuggacagucagugguucccgugaaauuagcuggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccguacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaauuuggacuagcgggagcagcauauccuuuugugguguaaacagugacacuguggguuggucuuggccagacggugcugaguugccauuuaccauugacaaguaa

SEQ ID NO: 56261 - RNA, 1410 nt, Artificial Sequence
  neuraminidase__InfluenzaA__AIM56284
augaauccaaaccaaaagauaauaaccauugguucggucuguauaacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagaugucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56262 - RNA, 1410 nt, Artificial Sequence; identical to SEQ ID NO: 56229
  neuraminidase__InfluenzaA__AIM56295

SEQ ID NO: 56263 - RNA, 1410 nt, Artificial Sequence
  neuraminidase__InfluenzaA__AIM56306
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaagcauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauuaagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56264 - RNA, 1410 nt, Artificial Sequence
  neuraminidase__InfluenzaA__AIM56317
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggacguguuugucauaagggaaccauucauaucaugcucccccuuggaaugcagaaccuucuucuugacucaaggggccuugcuaaaugacaaacauucuaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56265 - RNA, 1410 nt, Artificial Sequence
  neuraminidase__InfluenzaA__AIM56339
augaauccaaaccaaaagauaauaaccauugguucggucuguaugacaauuggaauggcuaacuuaauauuacaaauuggaaacauaaucucaauauggguuagucacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacagcaaagacaacaguguaagaaucgguuccaagggggauguguuugucauaagggaaccauucauaucaugcucccccuuggaaugcagaacuuucuucuugacucaaggggccuugcuaaaugacaaacauuccaauggaaccauuaaagacaggagcccauaucgaacccuaaugagcuguccuauuggugaaguucccucuccauacaacucaagauuugaaucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaaaagugacacuguggguuggucuuggccagacggugcugaguugccauuuaccauugacaaguaa

SEQ ID NO: 56266 - RNA, 1410 nt, Artificial Sequence
  neuraminidase__InfluenzaA__AIM56350
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaagcauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguauaaacagugacacuguggguuggucuuggccagacggugcugaguugccauuuaccauugacaaguaa

SEQ ID NO: 56267 - RNA, 1410 nt, Artificial Sequence; identical to SEQ ID NO: 56258
  neuraminidase__InfluenzaA__AIM56361

SEQ ID NO: 56268 - RNA, 1410 nt, Artificial Sequence
  neuraminidase__InfluenzaA__AIM56372
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaagcauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaauuuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacggacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56269 - RNA, 1410 nt, Artificial Sequence
  neuraminidase__InfluenzaA__AIM56383
augaauccaaaccaaaagauaauaaccauugguucggucuguaugacaauuggaauggcuaacuuaauauuacaaauuggaaacauaaucucaauauggguuagccacucaauucaacuugggaaucaaagucauauugaaacaugcaaucaaagcgucauuacuuaugaaaacaacacuuggguaaaucagacauauguuaacaucagcaacaccaacuuugcugcuggacaaucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56270 - RNA, 1410 nt, Artificial Sequence
  neuraminidase__InfluenzaA__AIM56394
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguccagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56271 - RNA, 1410 nt, Artificial Sequence; identical to SEQ ID NO: 56247
  neuraminidase__InfluenzaA__AIM56405

SEQ ID NO: 56272 - RNA, 1410 nt, Artificial Sequence
  neuraminidase__InfluenzaA__AIM56416
augaauccaaaccaaaagauaauaaccauugguucggucuguaugacaauuggaauggcuaacuuaauauuacaaauuggaaacauaaucucaauauggguuagccacucaauucaacuugggaaucaaagucauauugaaacaugcaaucaaagcgucauuacuuaugaaaacaacacuuggguaaaucagacauauguuaacaucagcaacaucaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaacgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56273 - RNA, 1410 nt, Artificial Sequence; identical to SEQ ID NO: 56247
  neuraminidase__InfluenzaA__AIM56428

SEQ ID NO: 56274 - RNA, 1410 nt, Artificial Sequence
  neuraminidase__InfluenzaA__AIM56439
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucgugcucccccuuggaaugcagaaccuucuucuugacucaaggggccuugcuaaaugacaagcauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56275 - RNA, 1410 nt, Artificial Sequence
  neuraminidase__InfluenzaA__AIM56450
augaauccaaaccaaaagauaauaaccauugguucggucuguaugacaauuggaauggcuaacuuaauauuacaaauuggaaacauaaucucaauauggauuagccacucaauucaaguugggaaucaaagucagaucgaaacaugcaaucaaagcgucauuacuuaugaaaacaacacuuggguaaaucagacauauguuaacaucagcaacaccaacuuugcugcugggcagccagugguuuccgugaaauuagcgggcaauuccucucucugcccuguuaguggaugggcuauauacaguaaagacaacaguguaagagucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaacggcauaauaacagacacuaucaagaguuggagaaacgauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauauaagauaggauacauaugcagugggauuuucggagauaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaguaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacgguggguuggucuuggccagacggugcugaguugccauuuaccauugacaaguaa

SEQ ID NO: 56276 - RNA, 1410 nt, Artificial Sequence
  neuraminidase__InfluenzaA__AIM56461
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaagaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaguaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56277 - RNA, 1410 nt, Artificial Sequence
  neuraminidase__InfluenzaA__AIM56472
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaaggaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuuguaaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56278 - RNA, 1410 nt, Artificial Sequence; identical to SEQ ID NO: 56235
  neuraminidase__InfluenzaA__AIM56483

SEQ ID NO: 56279 - RNA, 1410 nt, Artificial Sequence; identical to SEQ ID NO: 56258
  neuraminidase__InfluenzaA__AIM56494

SEQ ID NO: 56280 - RNA, 1410 nt, Artificial Sequence; identical to SEQ ID NO: 56248
  neuraminidase__InfluenzaA__AIM56505

SEQ ID NO: 56281 - RNA, 1410 nt, Artificial Sequence; identical to SEQ ID NO: 56247
  neuraminidase__InfluenzaA__AIM56516

SEQ ID NO: 56282 - RNA, 1410 nt, Artificial Sequence
  neuraminidase__InfluenzaA__AIM56527
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccugaugagcuguccuauuggugaaguucccucuccauacaacucaagauuugagucagucgcuuggucagcaagugcuugccaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguccucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugguuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56283 - RNA, 1410 nt, Artificial Sequence; identical to SEQ ID NO: 56255
  neuraminidase__InfluenzaA__AIM56538

SEQ ID NO: 56284 - RNA, 1410 nt, Artificial Sequence
  neuraminidase__InfluenzaA__AIM56549
augaauccaaaccaaaagauaauaaccauugguucggucuguaugacaauuggaauggcuaaccuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcugugcuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaagucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagugggagcagcauauccuuuugugguguaaacagugacacuguggguuggucuuggccagacggugcugaguugccauuuaccauugacaaguaa

SEQ ID NO: 56285 - RNA, 1410 nt, Artificial Sequence
  neuraminidase__InfluenzaA__AIM56560
augaauccaaaccaaaagauaauaaccauugguucggucuguaugacaauuggaauggcuaacuuaauauuacaaauuggaaacauaaucucaauauggguuagccacucaauucaacuugggaaucaaagucauauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggccauacacagcaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaacgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56286 - RNA, 1410 nt, Artificial Sequence; identical to SEQ ID NO: 56235
  neuraminidase__InfluenzaA__AIM56571

SEQ ID NO: 56287 - RNA, 1410 nt, Artificial Sequence
  neuraminidase__InfluenzaA__AIM56582
augaauccaaaccaaaagauaauaaccauugguucggucuguauaacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56288 - RNA, 1410 nt, Artificial Sequence
  neuraminidase__InfluenzaA__AIM56593
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccugaugagcuguccuauuggugaaguucccucuccauacaacucaagauuugagucagucgcuuggucagcaagugcuugccaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguccucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugagacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56289 - RNA, 1410 nt, Artificial Sequence
  neuraminidase__InfluenzaA__AIM56604
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaucaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56290 - RNA, 1410 nt, Artificial Sequence
  neuraminidase__InfluenzaA__AIM56615
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguugacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacagcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56291 - RNA, 1410 nt, Artificial Sequence; identical to SEQ ID NO: 56284
  neuraminidase__InfluenzaA__AIM56626

SEQ ID NO: 56292 - RNA, 1410 nt, Artificial Sequence
  neuraminidase__InfluenzaA__AIM56637
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaagcauuccaauggaaccaucaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56293 - RNA, 1410 nt, Artificial Sequence; identical to SEQ ID NO: 56235
  neuraminidase__InfluenzaA__AIM56648

SEQ ID NO: 56294 - RNA, 1410 nt, Artificial Sequence
  neuraminidase__InfluenzaA__AIM56659
augaauccaaaccaaaagauaauaaccauugguucggucuguaugacaauuggaauggcuaacuuaauauuacaaauuggaaacauaaucucaauauggguuagccacucaauucaacuugggaaucaaagucauauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagauaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauauuguaggaauaaaagaguggucaggauauagcgggaguuuuguucagcauccagaacuaacagggcuggauuguauaagaccuugcuucuggguugaacuaaucagagggcgacccgaagagaaaacaaucuggacuagcgggagcagcauauccuuuugugguguaaacagugacacuguggguuggucuuggccagacggugcugaguugccauuuaccauugacaaguaa

SEQ ID NO: 56295 - RNA, 1410 nt, Artificial Sequence
  neuraminidase__InfluenzaA__AIM56670
augaauccaaaccaaaagauaauaaccauugguucggucuguaugacaauuggaauggcuaacuuaauauuacaaauuggaaacacaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56296 - RNA, 1410 nt, Artificial Sequence; identical to SEQ ID NO: 56247
  neuraminidase__InfluenzaA__AIM56703

SEQ ID NO: 56297 - RNA, 1410 nt, Artificial Sequence
  neuraminidase__InfluenzaA__AIM56714
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaccgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggguauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56298 - RNA, 1410 nt, Artificial Sequence
  neuraminidase__InfluenzaA__AIM56725
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcugugcuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaagucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56299 - RNA, 1410 nt, Artificial Sequence; identical to SEQ ID NO: 56247
  neuraminidase__InfluenzaA__AIM56736

SEQ ID NO: 56300 - RNA, 1410 nt, Artificial Sequence
  neuraminidase__InfluenzaA__AIM56747
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucuuccuuggaaugcagaaccuucuucuugacucaaggggccuugcuaaaugacaaacauuccaauggaaccauuaaagacaggagcccauaucgaacccuaaugagcuguccuauuggugaaguuccuucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56301 - RNA, 1410 nt, Artificial Sequence
  neuraminidase__InfluenzaA__AIM56758
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcugugcuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaagucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56302 - RNA, 1410 nt, Artificial Sequence; identical to SEQ ID NO: 56247
  neuraminidase__InfluenzaA__AIM56769

SEQ ID NO: 56303 - RNA, 1410 nt, Artificial Sequence
  neuraminidase__InfluenzaA__AIM56780
augaauccaaaccaaaagauaauaaccauugguucggucuguaugacaauuggaauggcuaacuuaauauuacaaauuggaaacauaaucucaauauggguuagccacucaauucaacuugggaaucaaagucagauuggaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaaauucucaauaaagcaagauaucguaggaauacaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56304 - RNA, 1410 nt, Artificial Sequence
  neuraminidase__InfluenzaA__AIM56791
augaauccaaaccaaaagauaauaaccauugguucgguauguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccgaagagaacacuaucuggacuagcgggagcagcauauccuuuugugguguaaacagugacacuguggguuggucuuggccagacggugcugaguugccauuuaccauugacaaguaa

SEQ ID NO: 56305 - RNA, 1410 nt, Artificial Sequence
  neuraminidase__InfluenzaA__AIM56813
augaauccaaaccaaaagauaauaaccauugguucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaaaauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaauuuggacuagcgggagcagcauauccuuuugugguguaaacagugacacuguggguuggucuuggccagacggugcugaguugccauuuaccauugacaaguaa

SEQ ID NO: 56306 - RNA, 1410 nt, Artificial Sequence
  neuraminidase__InfluenzaA__AIM56824
augaauccaaaccaaaagauaauaaccauuggcucggucuguaugacaauuggaauggcuaacuuaauauuacaaauuggaaacauaaucucaauauggguuagccacucaauucaaauuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaccgucuaauggagcaaauggaguaaaaggauuuucauucaaauacagcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggguauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56307 - RNA, 1398 nt, Artificial Sequence
  neuraminidase__InfluenzaA__AIN76385
augaauccaaaucagaagauucuaugcacuucagccacugcuaucauaauaggcgcaaucgcaguacucauuggaauagcaaaccuaggauugaacauaggacugcaucuaaaaccgggcugcaauugcucacacucacaaccuggaacaaccaacacaagccaaacaauaauaaacaacuauuauaaugaaacaaacaucaccaacauccaaauggaagagagaacaagcaggaauuucaauagcuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaagcacuaguugccaugauggcaaauccaggaugucaauauguauaucaggaccaaacaacaaugcaucugcaguagugugguacaacagaaggccuguugcagaaauuaacacaugggcccgaaacauacuaagaacacaggaaucugaauguguaugccacaacggcauaugcccaauaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcaaggacaauuggcagggcucaaauagaccagugauucagauagacccaguagcaaugacacacacuagucaauauauaugcaguccuguucuuacagacacuccccgaccgaaugacccaaauauagguaaguguaaugacccuuaucccgguaauaacaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuagaauagaguacuuucucuaa

SEQ ID NO: 56308 - RNA, 1410 nt, Artificial Sequence
  neuraminidase__InfluenzaA__AIP93105
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcuacauguuuguaucacuggggaugauaaaaaugcaacugcuagcuucauuuaugacgggaggcuuguggacaguauugguucauggucucaaaauauccucagaacccaggagucggaaugcguuuguaucaaugggacuugcacaguagugaugacugauggaagugcuucaggaagagccgauacuagaauacuauucauugaagaggggaaaauuguccauauuagcccauugucaggaagugcucagcauguagaggaguguuccuguuauccucgauauccuggugucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 56309 - RNA, 1410 nt, Artificial Sequence
  neuraminidase__InfluenzaA__AIP93117
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 56310 - RNA, 1410 nt, Artificial Sequence
  neuraminidase__InfluenzaA__AIR93973
augaauccaaaccaaaagauaauaaccauugguucggucuguaugacaauuggaauggcuaacuuaauauuacaaauuggaaacauaaucucaauauggauuagccacuccauucaacuugggagucgaaaucaaauugaagcaugcaaucaaagcgucauuacuuaugaaaacaacacuuggguaaaucagacauauguuaacaucagcaacaccaacuuugcugcuggacagucagugguucccgugaaauuagcaggcaauuccucucuuugcccuguuaguggaugggcuauauacaguaaggacaacaguauaagaaucgguuccaagggggauguguuugucauaagggaaccauucauaucaugcucccccuuggaaugcagaaccuuuuucuugacucaaggggcauuguuaaaugauaaacauuccaauggaaccauuaaagacaggagcccauaucggacucuaaugagcuguccuauuggugaaguucccucuccauacaacucaagauuugagucagucgcuuggucagcaagugcuugucaugauggcaucaauuggcuaacaauuggaauuucugguccagacaauggggcaguggcuguauuaaaguacaacggcauaauaacagacacuaucaagaguuggagaaacaauauauugagaacacaggagucugaauguguauguguaaaugguucuuguuuuacuguaaugacagauggaccaaguaaugggcaggccucauacaagaucuucagaauagaaaagggaaagauagucaaaucggucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaccagauaggauacauaugcagugggauuuucggagacaacccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggaucccaacggauggacugagacagacaauaacuuuucaauaaagcaagauaucguagggauaaaugaguggucaggauauagcgggaguuuuguucagcauccagaacugacagggcuggauuguauaagaccuugcuucuggguugaacuaaucagagggcgacccaaagagaacacaaucuggacuagcgggagcagcauauccuuuugugguguaaacaguaacacuguggguuggucuuggccagacggugcugaguugccauuuaccauugacaaguaa

SEQ ID NO: 56311 - RNA, 1410 nt, Artificial Sequence
  neuraminidase__InfluenzaA__AIR93984
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauauccugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaauaaaugccccuaauuaucacuaugaggaaugcuccuguuauccugauucaagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggguuguauaagaccuugcuucuggguugaacuaaucagagggcgacccaaagagaacacaauauggacuagcgggagcagcauauccuuuugugguguaaacagugacacuguggguuggucuuggccagacggugcugaguugccauuuaccauugacaaguaa

SEQ ID NO: 56312 - RNA, 1410 nt, Artificial Sequence
  neuraminidase__InfluenzaA__AIR93995
augaauccaaaccaaaagauaauaaucauugguucggucuguaugacaauuggaauggcuaacuuaauauugcaaauuggaaacauaaucucaauauggauuagccacucaauucaacuugggaaucaaaaucagauugaaacaugcaaucaaagcgucauuacuuaugaaaacaacacuuggguaaaucagacauauguuaacauuagcaacaccaauuuugcugcuggacagucugugguucccgugaaauuagcgggcaauuccucucucugcccugugaguggaugggcuauauacaguaaagacaauaguauaagaaucgguuccaagggggauguguuugucauaagggaaccauucauaucaugcucacccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaaaaacaauauauugagaacacaagagucugaauguguauguguaaaugguucuugcuuuacuguaaugaccgauggaccaaguaauggacaggccucauacaagauuuucagaauagaaaagggaaaaauagucaaaucagucgaaaugaaugccccuaauuaucacuaugaggaaugcuccuguuauccugauucaagugaaaucacaugugugugcagggauaacuggcauggcucgaaucgaccaugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggaggacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggauggauuguauaagaccuugcuucuggguugaacuaaucagagggcgacccaaagagaacacaauuuggacuagcgggagcagcauauccuuuugugguguaaacagugacacuguggguuggucuuggccagacggugcugaguugccauuuaccauugacaaguaa

SEQ ID NO: 56313 - RNA, 1401 nt, Artificial Sequence
  neuraminidase__InfluenzaA__AIR94118
augaauccaaaucagaagauaauagcaauuggcucuguuucucuaaucauugcgauaauaugucuccucaugcagauugccaucuuaacaacgacuaugacacuacauuucagacagaaugaaugcaauaacucaucgaauaaucaagugaugccaugugaaccgaucauaauagagaggaacacagugcauuugaauagcacuaccauagagagggaaauuuguccuaaaguagcagaauacaagaauuggucaaaaccacaaugucaaauuacaggguuugcuccuuucucaaaggacaacucaauuaggcuuucugcggguggggauaucugggugacaagagaaccuuacgucucaugcagucucgacaaauguuaccaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuauaaugggaugcuuguugacaguauugguucaugguccaaaaacauccucagaacucaggagucagaaugcguuugcaucaauggaacuugugcagugguaaugacugauggaagugcaucaggaaaagccgacacuagaguauuauucauaaaagaagggaaaauuauaaauauuagcccauugucaggaagugcucagcacguugaggaaugcuccuguuauccccgguauccugaaguuaggugugucugcagagacaauuggaagggcuccaauaggcccauucuauauauaaauauggcugauuauagcauugaguccaguuaugugugcucaggacuuguuggugacacaccaagaaaugaugauagcuccagcagcagcaacugcaaagacccuaauagcgaaagaggggccccaggagugaaagggugggccuuugacgaugggaaugauguuuggaugggacggacaaucaaaaaugguucacgcucagguuaugagaccuuuagggucgucaaugguuggaccguggcuaauucaaagucacagguaaauaggcaagucauaguugacagugacgauuggucuggguauucuggcaucuucucuguugaaggcaaaaaaugcaucaacagguguuuuuauguggaguugauaagagggagaccacaagagcccagagugugguggaccucaaauagcaucauuguauucuguggaaccucagguacauauggaacaggcucauggccugauggagcgaauaucaacuucaugccuauauaa

SEQ ID NO: 56314 - RNA, 1410 nt, Artificial Sequence
  neuraminidase__InfluenzaA__AIT38335
augaauccaaaucaaaagauaauaacgauuggcucuguuucucucaccauugccacaauaugcuuccucaugcaaauugccauauuaguaaccacuguaacauuacauuucaagcaauaugaaugcaacucccccccaaccaaccagguaaugcugugugagccaacaauaauagaaagaaacauaacagagauaguguaucugaccaacaccaccauagagaaggagauaugccccaaacugguagaauacagaaauuggucaaagccgcaguguaaaauuacaggguuugcaccuuucucuaaggacaauucaauucgacuuucugcugguggggacauuugggugacaagagaaccuuaugugucaugcgauccugacaaguguuaucaauuugcccuuggacagggaacaacacuaaacaacaggcacucaaaugacacaguacaugauaggaccccuuaucgaacccuauugaugaaugaguuggguaucccauuucauuugggaaccaagcaagugugcauagcaugguccagcucaaguugucacgacggaaaagcauggcugcacguaugugucacuggacaugaugaaaaugcaacugccagcuucauuuacgaugggaggcucguagacaguauuguuucaugguccaaaagaauccucaggacccaggagucagaaugcgucuguaucgauggaacuuguacaguaguaaugacugaugggagugcuucgggaagagcugauacuagaauacuauucauaaaggaggggaaaaucauucauauuagccaauugucaggaagugcucagcaugucgaggagugcuccuguuauccucgcuauccuggugucagaugugucugcagagacaacuggaaaggcuccaauaggcccauuguagacauaaauguaaaggauuauagcaucaauuccaguuaugugugcucaggacuuguuggagauacacccagaaaaaacgacaguuucagcaguagcuauugccugaauccuaacaaugaagaaggaggucauggagugaaaggcugggccuuugaugauggagaugacguguggaugggaagaacgaucaaugagaaguuacgcucagguuaugaaaccuucaaggucauuaaaggcugguccaaaccuaacuccaaauugcaaauaaauaggcaagucauaguugacagggguaauagguccgguuauucugguauuuucucuguugaaggcaaaggcugcaucaaucgguguuuuuauguggaguugauaaggggaaggaaacaggaaacugaagucugguggaccucaaacaguauuguuguguuuuguggcaccucagguacauauggaacaggcucauggccugacggggcgaacaucaaccucaugccuauauaa

SEQ ID NO: 56315 - RNA, 1410 nt, Artificial Sequence
  neuraminidase__InfluenzaA__AIT38346
augaauccuaaucaaaagauaauaacgauugguucuauuucucucaccauugccacaauaugcuuccuuuugcaaguggccaucuugguaaccacuguaacauugcauuucaagcaauuugaaugcaacccaaccccaaacaaccaaguaaugcugugugagccaacaguaauagaaagaaauauaacaaagauaguguaucugaccaacaccacuguagagaaagaaauaugccccaaaccagcagaauacagaaauuggucaaagccgcaauguaaaauuacaggauuugcaccuuuuucuaaggacaauucaauucggcucucugccgguggggacauuuggguaacaagagaaccuuauguaucaugcgcuccuaacaagugcuaucaauuugcccuuggacagggaacaaccuuaaacaacaggcauucaaaugacacaguacaugauagaaccccuuaucgaacccuauugaugaaugaguuggguauuccauuucauuugggaaccaagcaagugugcauagcaugguccagcucaaguugucacgauggaaaagcauggcugcacguuuguguaacugggcaugauaaaaaugcaacugccagcuucauuuaugaugggaggcuuguagacaguauugguucaugguccaaaaacauccucagaacccaggagucagaaugcguuuguaucaauggaaccuguacaguaguaaugacugauggaagugcuucaggaagagcugauaccaaaauacuauucauuaaggaggggaaaaucauucauauuagccaauugucaggaagugcacaacauguagaggaaugcuccuguuauccucgauauccugguguuagaugugucugcagagacaacuggaaaggcuccaauaggcccauuguggauauaaaugugagggauuauagcaucgucuccaguuaugugugcucaggacuuguuggagacacacccaggaaaaacgacaguuucagcaguagccacugccugaauccuaacaaugaagaaggaggucauggagugaaaggcugggccuuugaugauggagaugacguguggaugggaagaacgaucagugagaaauuacgcucagguuaugaaaccuucaaggucauuaaaggcugguccaaaccuaacuccaaauugcagauaaauaggcaagucauaguugacagagguaauagguccgguuauucugguauauucucuguugaaggcaaaagcugcauaaaucggugcuuuuauguggaguugauaaggggaaggaaacaggaaacugaagucugguggaccucaaacaguauuguuguguuuuguggcacuucagguacauauggaacaggcucauggccugacggggcggacaucaaucucaugccuauauaa

SEQ ID NO: 56316 - RNA, 1410 nt, Artificial Sequence
  neuraminidase__InfluenzaA__AIT38361
augaauccuaaucaaaagauaauaacaauugguucuauuucucucaccauugccacaauaugcuuccuuaugcaaguggccaucuugguaaccacuguaacauugcauuucaagcaauaugaaugcaacucaaccccaaacaaccaaguaaugcugugugagccaacaguaauagaaagaaauauaacaaagauaguguaucugaccaacaccacuguagugaaagaaguaugccccaaaccagcagaauacagaaauuggucaaagccgcaauguaaaauuacaggauuugcaccuuuuucuaaggacaauucaauucggcucucugccgguggggacauuuggguaacaagagaaccuuauguaucaugcgcuccuaacaagugcuaucaauuugcccuuggacagggaacaaccuuaaacaacaggcauucaaaugacacaguacaugauagaaccccuuaucgaacccuauugaugaaugaguuggguauuccauuucauuugggaaccaagcaagugugcauagcaugguccagcucaaguuguuacgauggaaaagcauggcugcacguuuguguaacugggcaugauaaaaaugcaacugccagcuucauuuacgaugggaggcuuguagacaguauugguucaugguccaaaaacauccucagaacccaggagucagaaugcguuuguaucaauggaaccuguacaguaguaaugacugauggaagugcuucaggaagagcugauaccaaaauacuauucauuaaggaggggaaaaucauucauauuagccaauugucaggaagugcacaacauguggaggaaugcuccuguuauccucgauauccugguguuagaugugucugcagagacaacuggaaaggcuccaauaggcccauuguggauauaaauaugagggauuauagcaucgucuccaguuaugugugcucaggacuuguuggagacacacccagggaaaacgacaguuucagcaguagccacugccugaauccuaacaaugaagaaggaggucauggagugaaaggcugggccuuugaugauggagaugacguguggaugggaagaacgaucagugagaaauuacgcucagguuaugaaaccuucaaggucauuaaaggcugguccaaaccuaacuccaaauugcagauaaauaggcaagucauaguugacagagguaauagguccgguuauucugguauauucucuguugaaggcaaaagcugcauaaaucggugcuuuuauguggaguugauaaggggaaggaaacaggaaacugaagucugguggaccucaaacaguauuguuguguuuuguggcacuucagguacauauggaacaggcucauggccugacggggcggacaucaaucucaugccuauauaa

SEQ ID NO: 56317 - RNA, 1410 nt, Artificial Sequence
  neuraminidase__InfluenzaA__AIT38375
augaauccaaaccaaaagauaauaaccauugguucggucuguaugacaauuggaaugguuaacuuaauauuacaaauuggaaacauaaucucaauauggauuagccacucaauucaacuugggaaucaaaaucagauugaaauaugcaaucaaagcgucauuacuuaugaaaacaacacuuggguaaaucagacauauguuaacaucagcaacaccaacuuugcugcuggacagucagugguucccgugaaauuagcgggcaauuccucucucugcucuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucaguugcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucaagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56318 - RNA, 1410 nt, Artificial Sequence
  neuraminidase__InfluenzaA__AIT93148
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacaccuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56319 - RNA, 1410 nt, Artificial Sequence
  neuraminidase__InfluenzaA__AIU39701
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 56320 - RNA, 1410 nt, Artificial Sequence; identical to SEQ ID NO: 50325
  neuraminidase__InfluenzaA__AIU39703

SEQ ID NO: 56321 - RNA, 1410 nt, Artificial Sequence
  neuraminidase__InfluenzaA__AIU39705
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaauacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56322 - RNA, 1413 nt, Artificial Sequence
  neuraminidase__InfluenzaA__AIU46611
augaauccaaaucaaaagauaacaugcauuucagcaacaggaaugacacuaucgguaguaaguaugcuaauaggaauugccaauuugggcuuaaauaucggacuccacuauaaagugggugauucaacaaauauaaacauuccaaacaugaaugaaaccagcccaacaacaacaauaauaaauaaucacccucagaauaauuucacaaacaucacuaacauuauagugacuaggaacgaggaaggacaucuucucaaccugaccaagccgcuaugugaagucaacucauggcauauucuaucgaaagacaaugcaauaagaauaggugaggaugcucauauaauagucacaagggaaccuuacuuguccugcgauccacagggcugcaggauguuugcucugagccaaggaacaacacucagagggaaacaugcgaauggaaccauacaugacaggagcccauuccgagcucuuguaaguugggaaaugggucaggcgcccaguccauauaauacuagggucgagugcauaggauggucaagcacgucaugccacgauggcauaucaaggaugucaauaugcauaucaggaccgaauaacaaugcaucggcaguagugugguauggggggagaccaguaacagagauccccucaugggcagggaacauucuuaggacucaagaaucggagugugugugccauggaggaauauguccaguggucaugacagaugguccggcaaacaacagggcagaaacuaaaauaaucuauuucaaagaaggaaagauaaagaaaauugaagaacugaagggggacgcucaacacaucgaagaguguucauguuauggagcaucagagaugaucaaguguauaugcagggacaauuggaaaggggcaaacagaccaguaauaacuauagaucccgagaugaugacccacacaagcaaguacuuguguucaaaaauccuaaccgauacaagccgucccaaugaccccaccaaugggaacugcgaagcgccaauaacaggagggagcccagacccugggguaaaaggguuugcauuccuagacggugagaacucauggcuuggaaggacuauuagcaaagacuccaggucaggcuaugaaauguuaaaaguuccaaaugcagagaccgacacucaaucgggggcaaucucacaccagauuauugucaacaaccagaauuggucaggguacucuggggcauucauugacuacugggcaaacaaggaaugcuucaauccuuguuucuauguggaacuaaucagagggagacccaaagagaguaguguacuguggacuucaaauagcauuguagcucucuguggauccaaggagcgauugggaucaugguccuggcaugauggugcugaaaucaucuacuuuaaguag

SEQ ID NO: 56323 - RNA, 1410 nt, Artificial Sequence
  neuraminidase__InfluenzaA__AIV09221
augaauccaaaccaaaagauaauaaccauugguucggucuguaugacaauuggaauggcuaacuuaauauuacaaauuggaaacauaaccucaauauggauuagccacucaauucaaauugggaaccggaaucaaauugaagcaugcaaucaaagcgucauuacuuaugaaaacaacacuuggguaaaucagacauauguuaacaucagcaacaccaacuuugcuguuggacagucagugguuccugugaaauuagcgggcaauuccucucuuugcccugucaguggaugggcuauauacaguaaggacaacaguauaagaaucgguucuaagggggauguguuugucauaagggaaccauucauaucaugcucccccuuggaaugcagaacauuuuucuugacucaaggggcauuguuaaaugauaaacauuccaauggaaccauuaaagacaggagcccauaucggacccuaaugagcuguccuauuggugaaguucccucuccauacaacucaagauuugagucagucgcuuggucagcaagugcuugucaugauggcaucaauuggcuaacaauuggaauuucugguccagacaauggggcaguggcuguauuaaaguacaacggcauaauaacagacacuaucaagaguuggagaaacaauauauugagaacacaggagucugaauguguauguguaaaugguucuuguuuuacuguaaugacagauggaccaaguaaugggcaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcaguggaauuuucggagacaacccacgcccuaaugacaagacagguaguugugguccaguaccgucuaauggagcaaauggaguaaaaggauuuucauucaaauacggcaaugguguuuggauagggagaacuaaaagcauuaguucaagaaacgguuuugagaugauuugggaucccaauggauggacugagacagacaaugacuucucaauaaagcaagauaucguagggauaaaugaguggucaggguauagcgggaguuuuguucagcauccagaacugacagggcuggauuguauaagaccuugcuucuggguugaacuaaucagggggcgacccaaagagaacacaaucuggacuagcgggagcagcauauccuuuugugguguaaacaguaacacuguggauuggucuuggccagacggugcugaguugccauuuaccauugacaaguaa

SEQ ID NO: 56324 - RNA, 1410 nt, Artificial Sequence
  neuraminidase__InfluenzaA__AIW60703
augaauccaaaucaaaagauaauaacuauuggcucuguuucucucacuauugccacaauaugcuuccuuaugcaaauugucauccugguaacuacuguaacauuacauuucaagcaauaugaaugcaacucccccccaaacaaccaaguaaugcugugugaaccaacaauaauagaaagaaacauaacagagauaguguaucugaccaacaccacaauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuuccggaagagcugauacuaaaauacuauucauugaagaggggaaaaucguucauauuagcccauugucaggaagugcucagcaugucgaggagugcuccuguuauccucaauauucuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauuggaggcugguccaagccuaacuccaaauugcaaauaaauaggcaagucauaguugacagagguaauagguccgguuauucugguauuuucucuguugaaggcaaaaacugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 56325 - RNA, 1410 nt, Artificial Sequence
  neuraminidase__InfluenzaA__AIW60704
augaauccaaaucaaaagauaauaacuauuggcucuguuucucucacuauugccacaauaugcuuccuuaugcaaauugucauccugguaacuacuguaacauuacauuucaagcaauaugaaugcaacucccccccaaacaaccaaguaaugcugugugaaccaacaauaauagaaagaaacauaacagagauaguguaucugaccaacaccacaauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacauaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuuccggaagagcugauacuaaaauacuauucauugaagaggggaaaaucguucauauuagcccauugucaggaagugcucagcaugucgaggagugcuccuguuauccucaauauucuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauuggaggcugguccaagccuaacuccaaauugcaaauaaauaggcaagucauaguugacagagguaauagguccgguuauucugguauuuucucuguugaaggcaaaaacugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 56326 - RNA, 1410 nt, Artificial Sequence
  neuraminidase__InfluenzaA__AIW60705
augaauccaaaucaaaagauaauaacuauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuuccggaagagcugauacuaaaauacuauucauugaagaggggaaaaucguucauauuaguccauugucaggaagugcucagcaugucgaggagugcuccuguuauccucgauauucuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuucgcucagguuaugaaaccuucaaagucauuggaggcugguccaaaccuaacuccaaauugcaaauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 56327 - RNA, 1410 nt, Artificial Sequence; identical to SEQ ID NO: 56326
  neuraminidase__InfluenzaA__AIW60706

SEQ ID NO: 56328 - RNA, 1410 nt, Artificial Sequence
  neuraminidase__InfluenzaA__AIW60708
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucaauucggcuuuccgcugguggagacauuugggugacaagagagccuuaugugucaugcgauccugacaaguguuaucaauuugcccuuggacagggaacaacacuaaacaacaggcauucaaaugacacaguacaugauaggaccccuuaucguacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauauuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagguggucauggagugaaaggcugggccuuugaugauggaaaugacguguggaugggaagaacgaucagcgagaaguuacgcucagguuaugaaaccuucaaagucauugaaggcugguccaacccuaacuccaaauugcagauaaauaggcaagucauaguugacagagguaauaguuccgguuauucugguauuuucuccguugaaggcaaaagcugcaucaaucggugcuuuuauguggaguugauaaggggaaggaaacaggaaacugaagucugguggaccucaaacaguauuguugugcuuuguggcaccucagguacauauggaacaggcucauggccugauggggcggacaucaaucucaugccuauauaa

SEQ ID NO: 56329 - RNA, 1410 nt, Artificial Sequence
  neuraminidase__InfluenzaA__AIW60710
augaauccaaaucaaaagauaauaacgauuggcucuguuucucucaccauugccacaauaugcuuccuuaugcaaauugccaucuugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaauguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaccguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 56330 - RNA, 1410 nt, Artificial Sequence
  neuraminidase__InfluenzaA__AIW60711
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaacguaaaggauuauagcauuguuuccaguuauguguguucaggacuuguuggagacacacccagaaaaaacgacagcuucagcaguagccauuguuuggauccuaacaaugaagaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 56331 - RNA, 1410 nt, Artificial Sequence; identical to SEQ ID NO: 45095
  neuraminidase__InfluenzaA__AIW60712

SEQ ID NO: 56332 - RNA, 1410 nt, Artificial Sequence
  neuraminidase__InfluenzaA__AIW60713
augaauccaaaucaaaagauaauaacgauuggcucuguuucucucaccauuuccacaauaugcuucuucaugcaaauugccaucuugauaacuacuguaacauugcauuuuaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggacgauaaaaaugcaacugcuagcuucauuuacaaugggaggcuuguagauaguauuguuucaugguccaaagaaauccucaggacccaggagucagaaugcguuuguaucaauggaacuuguacaguaguaaugaccgaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauugcuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaaggacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56333 - RNA, 1410 nt, Artificial Sequence
  neuraminidase__InfluenzaA__AIW60714
augaauccaaaucaaaagauaauaacgauuggcucuguuucucucaccauuuccacaauaugcuucuucaugcaaauugccaucuugauaacuacuguaacauugcauuuuaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggacgauaaaaaugcaacugcuagcuucauuuacaaugggaggcuuguagauaguauuguuucaugguccaaagaaauccucaggacccaggagucagaaugcguuuguaucaauggaacuuguacaguaguaaugaccgaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauugcuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaaggacgaucagcgagaaguuacgcucaggauaugaaaccuucaaagucauugaaggcugguccaacccuaauuccaaauugcagauaaauaggcaagucauaguuggcagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56334 - RNA, 1410 nt, Artificial Sequence
  neuraminidase__InfluenzaA__AIW60715
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuggguguuccuuuucauuuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaauauaaaggaucauagcauuguuuccaguuaugugugcucaggacuuguuggagacacacccagaaaaaacgacagcuccagcaguagccauuguuuagauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56335 - RNA, 1410 nt, Artificial Sequence
  neuraminidase__InfluenzaA__AIW60716
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcacuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucgcgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56336 - RNA, 1410 nt, Artificial Sequence
  neuraminidase__InfluenzaA__AIY54970
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaccgacagcuccagcaguagccauugcuuggauccaaacaaugaggaagguggucauggagugaaaggcugggcauuugaugauggaaaugaccuguggaugggaagaacgaucagccagaacuuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 56337 - RNA, 1410 nt, Artificial Sequence
  neuraminidase__InfluenzaA__AIY54974
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugagugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucaaaguugacagagguaauagguccgguuauucugguauuuucucuguugaaggcaaaagcugcaucaaucggugcuuuuauguggaguugauaaggggaagaaaagaggaaacuaaagucuuguggaccucaaacaguauuguuguguuuuguggcaccucagguacauauggaacaggcucauggccugauggggcggacaucaaucucaugccuauauaa

SEQ ID NO: 56338 - RNA, 1410 nt, Artificial Sequence
  neuraminidase__InfluenzaA__AIY54982
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuccgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56339 - RNA, 1410 nt, Artificial Sequence
  neuraminidase__InfluenzaA__AIY54990
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguggcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucgguguuuuuauguggaguugauaaggggaagaaaagaggaaacugaaguuuuguggaccucaaacaguauuguuguguuuuguggcaccuccgguacauauggaacaggcucauggccugauggggcggacaucaaucucaugccuauauaa

SEQ ID NO: 56340 - RNA, 1401 nt, Artificial Sequence
  neuraminidase__InfluenzaA__AJD78177
augaauccaaaucagaagauaauagcaauuggcucuguuucucuaaucauugcgguaauaugucuccucaugcagauugccaucuuaacaacgacuaugacacuacauuucaugcagaaugaaugcaguaacccaucgaauaaucaagugaugccaugugaaccgaucauaauagagagaaacacagugcauuugaauaauacuaccauagagagagaaauuuguccuaaagcagcagaguacaagaauuggucaaaaccacaaugucaaauuacaggguucgcuccuuucucaaaagacaacucaauuaggcuuucugcagguggggauaucugggugacaagagaaccuuaugucucaugcagucucgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaaggaaaaauuauaaauauuagcccauugucaggaagugcucagcacguugaggaaugcuccuguuauccucgguauccugaaguuagguguguuugcagagacaauuggaagggcuccaauaggcccauucuauauauaaauauggcugauuauagcauugaguccaguuauguuugcucaggacuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagacuuuuagggucgucaaugguuggaccauggcuaauucaaagucacagauaaauaggcaagucauaguugacagugacgacuggucuggguauucuggcaucuucucuguugaaggcaaaaagugcaucaacagguguuuuuauguagaguugauaagagggagaccacaggaacccagagugugguggaccucaaacagcaucauuguauucuguggaaccucagguacauauggaacaggcucauggccugauggagcgaauaucaacuucaugccuauauaa

SEQ ID NO: 56341 - RNA, 1401 nt, Artificial Sequence
  neuraminidase__InfluenzaA__AJD78189
augaauccaaaucagaagauaauagcaauuggcucuguuucucuaaucauugcgauaauaugucuccucaugcagauugccaucuuaacaacgacuaugacacuacauuucagacagaaugaaugcaauaacucaucgaauaaucaagugaugccaugugaaccgaucauaauagagaggaacacagugcaucugaacagcacuaccauagagagggaaauuuguccuaaaguagcagaauacaagaauuggucaaaaccacaaugucaaauuacaggguuugcuccuuucucaaaggacaacucgauuaggcuuucugcagguggggauaucugggugacaagggaaccuuacgucucaugcagucucgacaaauguuaccaauuugcacuugggcagggaaccacccugaaaaacaagcacucaaauggaacuacacaugauagaaccucucacagaacucuuuuaaugaaugaguuagguguuccauuucauuugggaaccaaacaagugugcauagcauggucuaguucaagcugcuaugauggaaaagcaugguuacauauuuguguuacuggggaugauaaaaaugcuacugcuaguaucaucuauaaugggaugcuuguugacaguauugguucaugguccaaaaacauccucagaacucaggagucagaaugcguuugcaucaauggaacuugugcagugguaaugacugauggaagugcaucaggaaaggccgacacuagaguauuauucauaagagaagggaaaauuauaaauauuagcccauugucaggaagugcucagcacguugaggaaugcuccugcuauccccgguaucccgaaguuaggugugucugcagagacaauuggaagggcuccaauaggcccauucuauauauaaauauggcugauuauagcauugaguccaguuaugugugcucaggacuuguuggugacacaccaagaaaugaugauagcuccagcagcagcaacugcaaagacccuaauagcgaaagaggggccccaggagugaaagggugggccuuugacgaugggaaugauguuuggaugggacggacaaucaaaaaugguucacgcucggguuaugagacuuuuaggguccucaaugguuggaccguggccaauucaaagucacagauaaauaggcaaguuauaguugauagugacgauuggucuggguauucuggcaucuucucuguugaaggcaaaaaaugcaucaacagguguuuuuauguggaguugauaagagggagaccacaagagcccagagugugguggaccucaaauagcaucauuguauucuguggaacaucagguacauauggaacaggcucauggccugauggagcgaauaucaacuucaugccuauauaa

SEQ ID NO: 56342 - RNA, 1401 nt, Artificial Sequence
  neuraminidase__InfluenzaA__AJD78201
augaauccaaaucagaagauaacagcaauuggcucuguuucucuaaucauugcgauaauaugucuccucaugcaaauugccaucuuaacaacgacuaugacauuacauuucaggcagaaagaaugcaguaacccaucgaauaaucaaguaaugccaugugaaccgaucauaauagaaaggaacacagugcauuugaauaguacuaccauagagagggaaauuuguccuaaaguagcagaauacaagaauuggucaaaaccacaaugucuaauuacaggguucgcuccuuucucaaaggacaacucaauuaggcuuucugcagguggggauaucugggugacaagagaaccuuaugucucaugcagucccgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauuggcucaugguccaaaaacauccucagaacucaggagucagaaugcguuugcaucaauggaacuugugcagugguaaugacugauggaagugcaucaggaguggccgacacuagaguauuauucauaagagaaggaaaaauuauaaauauuagaccauugucaggaagugcucagcacguugaggaaugcuccuguuauccccgauauccugaaguuagguguguuugcagagacaauuggaagggcuccaauaggcccauuauauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggcuuuugacgacgggaaugauguuuggaugggacggacaaucaaaaaugguucacgcucagguuaugagacuuuuagggucauaaaugguuggacuauggcuaauucaaagucacagauaaauaggcaagucauaguugacagugacgacuggucuggguauuccggcaucuucucuguugaaggcaaaaaaugcaucaacagguguuuuuauguggaguugauaagagggagaccacaggaacccagagugugguggaccucaaauagcaucauuguauucuguggaaccucagguacauaugggacaggcucauggccugauggagcgaauaucaacuucaugccuauauaa

SEQ ID NO: 56343 - RNA, 1401 nt, Artificial Sequence
  neuraminidase__InfluenzaA__AJD78213
augaauccaaaucagaagauaacagcaauuggcucuguuucucuaaucauugcgauaauaugucucuucaugcaaauugccaucuuaacaacgacuaugacauuacauuucaggcagaaagaaugcaguaacccaucgaauaaucaaguaaugccaugugaaccgaucauaauagaaaggaacacagugcauuugaauaguacuaccauagagagggaaauuuguccuaaaguagcagaauacaagaauuggucaaaaccacaaugucuaauuacaggguucgcuccuuucucaaaggacaacucaauuaggcuuucugcagguggggauaucugggugacaagagaaccuuaugucucaugcagucccgacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugauaaaaaugcuacugcuaguaucaucuaugaugggaugcuuguugacaguauuggcucaugguccaaaaacauccucagaacucaggagucagaaugcguuugcaucaauggaacuugugcagugguaaugacugauggaagugcaucaggaguggccgacacuagaguauuauucauaagagaaggaaaaauuauaaauauuagaccauugucaggaagugcucagcacguugaggaaugcuccuguuauccccgguauccugaaguuagguguguuugcagagacaauuggaagggcuccaauaggcccauuauauauauaaauauggcugauuauagcauugaguccaguuaugugugcucaggacuuguuggcgacacaccaagaaaugaugauagcuccagcagcagcaacugcagagacccuaauaacgaaagaggggccccaggagugaaagggugggcuuuugacgacgggaaugauguuuggaugggacggacaaucaaaaaugguucacgcucagguuaugagacuuuuagggucauaaaugguuggacuauggcuaauucaaagucacagauaaauaggcaagucauaguugacagugacgacuggucuggguauuccggcaucuucucuguugaaggcaaaaaaugcaucaacagguguuuuuauguggaguugauaagagggagaccacaggaacccagagugugguggaccucaaauagcaucauuguauucuguggaaccucagguacauaugggacaggcucauggccugauggagcgaauaucaacuucaugccuauauaa

SEQ ID NO: 56344 - RNA, 1410 nt, Artificial Sequence; identical to SEQ ID NO: 55719
  neuraminidase__InfluenzaA__AJI80140

SEQ ID NO: 56345 - RNA, 1410 nt, Artificial Sequence; identical to SEQ ID NO: 55719
  neuraminidase__InfluenzaA__AJI80152

SEQ ID NO: 56346 - RNA, 1410 nt, Artificial Sequence; identical to SEQ ID NO: 56202
  neuraminidase__InfluenzaA__AJI80164

SEQ ID NO: 56347 - RNA, 1410 nt, Artificial Sequence; identical to SEQ ID NO: 56203
  neuraminidase__InfluenzaA__AJI80175

SEQ ID NO: 56348 - RNA, 1410 nt, Artificial Sequence; identical to SEQ ID NO: 56142
  neuraminidase__InfluenzaA__AJI80187

SEQ ID NO: 56349 - RNA, 1410 nt, Artificial Sequence; identical to SEQ ID NO: 56142
  neuraminidase__InfluenzaA__AJI80199

SEQ ID NO: 56350 - RNA, 1410 nt, Artificial Sequence
  neuraminidase__InfluenzaA__AJI80211
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagggacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaagcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56351 - RNA, 1410 nt, Artificial Sequence
  neuraminidase__InfluenzaA__AJI80223
augaauccaaaucaaaagauaauaacgauuggcucuguuucucucaccauuuccacaauaugcuucuucaugcaaauugccaucuugauaacuacuguaacauugcauuucaagcaauaugaauucgacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56352 - RNA, 1410 nt, Artificial Sequence; identical to SEQ ID NO: 56203
  neuraminidase__InfluenzaA__AJI80235

SEQ ID NO: 56353 - RNA, 1410 nt, Artificial Sequence; identical to SEQ ID NO: 56351
  neuraminidase__InfluenzaA__AJI80247

SEQ ID NO: 56354 - RNA, 1410 nt, Artificial Sequence; identical to SEQ ID NO: 56160
  neuraminidase__InfluenzaA__AJI80259

SEQ ID NO: 56355 - RNA, 1410 nt, Artificial Sequence; identical to SEQ ID NO: 56138
  neuraminidase__InfluenzaA__AJI80271

SEQ ID NO: 56356 - RNA, 1410 nt, Artificial Sequence; identical to SEQ ID NO: 56142
  neuraminidase__InfluenzaA__AJI80283

SEQ ID NO: 56357 - RNA, 1410 nt, Artificial Sequence
  neuraminidase__InfluenzaA__AJI80306
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacuugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagggacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaagcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56358 - RNA, 1410 nt, Artificial Sequence
  neuraminidase__InfluenzaA__AJI80318
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaagcaugcaaucaaaacgucauuacuuaugaaaacaacacuuggguaaaucagacauauguuaacaucagcaacaccaacuuugcuacuggacagucagugguuuccgugaaauuagcgggcaauuccucucucugcccuguuaguggaugggcuauauacaguaaagacaacaguguaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggguggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56359 - RNA, 1410 nt, Artificial Sequence
  neuraminidase__InfluenzaA__AJI80329
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaauuuugcugcuggacagucagugguuuccgugaaauuagcgggcaauuccucccucugcccuguuaguggaugggccauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaaaaauaauauauugagaacacaagagucugaaugugcauguguaaaugguucuugcuuuaccauaaugaccgauggaccaagugacggacaggccucauacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56360 - RNA, 1410 nt, Artificial Sequence
  neuraminidase__InfluenzaA__AJI80340
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaccgaacccuaaugagcuguccuauuggugaaguucccucuccauacaacucaagauuugagucggucgcuuggucagcaagugcuugucaugauggcaucaauuggcuaacaauuggaauuucuggcccagacaguggggcaguggcuguauuaaaguacaauggcauaauaacagacacuaucaagaguuggaaaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgaccuaaagagaacacaaucuggacuagcgggagcagcauauccuuuugugguguaaacagugacacuguggguuggucuuggccagacggugcugaguugccauuuaccauugacaaguaa

SEQ ID NO: 56361 - RNA, 1410 nt, Artificial Sequence
  neuraminidase__InfluenzaA__AJI80351
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucugucgaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56362 - RNA, 1410 nt, Artificial Sequence
  neuraminidase__InfluenzaA__AJI80363
augaauccaaaucaaaagauaauaacgauuggcucuguuucucucaccauuuccacaauaugcuucuucaugcaaauugccaucuugauaacuacuguaacauugcauuucaagcaauaugaauucaacucccucccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacagcacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaggugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuugaauccuaacaaugaagaagguggucauggagugaaaggcugggccuuugaugauggaaacgacguauggaugggaagaacaaucaacgagacaucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56363 - RNA, 1410 nt, Artificial Sequence
  neuraminidase__InfluenzaA__AJI80375
augaauccaaaucaaaagauaauaacgauuggcucuguuucucucaccauuuccacaauaugccucuucaugcaaauugccaucuugauaacuacuguaacauugcauuucaagcaacaugaauucaacucccccccaaacaaccaagugaugcuaugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuuuucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56364 - RNA, 1410 nt, Artificial Sequence; identical to SEQ ID NO: 56180
  neuraminidase__InfluenzaA__AJI80387

SEQ ID NO: 56365 - RNA, 1410 nt, Artificial Sequence; identical to SEQ ID NO: 56180
  neuraminidase__InfluenzaA__AJI80398

SEQ ID NO: 56366 - RNA, 1410 nt, Artificial Sequence; identical to SEQ ID NO: 56180
  neuraminidase__InfluenzaA__AJI80409

SEQ ID NO: 56367 - RNA, 1410 nt, Artificial Sequence; identical to SEQ ID NO: 56180
  neuraminidase__InfluenzaA__AJI80420

SEQ ID NO: 56368 - RNA, 1410 nt, Artificial Sequence; identical to SEQ ID NO: 56180
  neuraminidase__InfluenzaA__AJI80431

SEQ ID NO: 56369 - RNA, 1410 nt, Artificial Sequence; identical to SEQ ID NO: 56175
  neuraminidase__InfluenzaA__AJI80442

SEQ ID NO: 56370 - RNA, 1410 nt, Artificial Sequence; identical to SEQ ID NO: 56180
  neuraminidase__InfluenzaA__AJI80454

SEQ ID NO: 56371 - RNA, 1410 nt, Artificial Sequence; identical to SEQ ID NO: 56175
  neuraminidase__InfluenzaA__AJI80465

SEQ ID NO: 56372 - RNA, 1410 nt, Artificial Sequence; identical to SEQ ID NO: 56180
  neuraminidase__InfluenzaA__AJI80477

SEQ ID NO: 56373 - RNA, 1410 nt, Artificial Sequence; identical to SEQ ID NO: 56180
  neuraminidase__InfluenzaA__AJI80488

SEQ ID NO: 56374 - RNA, 1410 nt, Artificial Sequence; identical to SEQ ID NO: 56202
  neuraminidase__InfluenzaA__AJI80499

SEQ ID NO: 56375 - RNA, 1410 nt, Artificial Sequence; identical to SEQ ID NO: 56191
  neuraminidase__InfluenzaA__AJI80510

SEQ ID NO: 56376 - RNA, 1410 nt, Artificial Sequence; identical to SEQ ID NO: 56202
  neuraminidase__InfluenzaA__AJI80521

SEQ ID NO: 56377 - RNA, 1410 nt, Artificial Sequence
  neuraminidase__InfluenzaA__AJJ98767
augaauccaaaucaaaagauaauaacgauuggcucuguuucucucaccauuuccacaauaugcuucuucaugcaaauugccaucuugauaacuacuguaacauugcauuucaagcaauaugaauucaacucccccucaaacaaccaagugaugcugugugaaccaacaauaauagaaagaaacauaacagagauaguguaucugaccaacaccaccauagagaaggaaaaaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauaccagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggagaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugacgucuuguggaccucaaacaguauuguuguguuuuguggcaccucagguacauauggaacaggcucauggccugauggggcggacaucaaucucaugccuauauaa

SEQ ID NO: 56378 - RNA, 1410 nt, Artificial Sequence
  neuraminidase__InfluenzaA__AJJ98779
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaacccuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucauggaccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgauuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56379 - RNA, 1410 nt, Artificial Sequence; identical to SEQ ID NO: 53466
  neuraminidase__InfluenzaA__AJJ98791

SEQ ID NO: 56380 - RNA, 1410 nt, Artificial Sequence
  neuraminidase__InfluenzaA__AJJ98803
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacaaaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuucuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56381 - RNA, 1410 nt, Artificial Sequence
  neuraminidase__InfluenzaA__AJJ98815
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggagggaaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaaguccuguggaccucaaacaguauuguuguguuuuguggcaccucagguacauauggaacaggcucauggccugauggggcggaccucaaucucaugccuauauaa

SEQ ID NO: 56382 - RNA, 1410 nt, Artificial Sequence
  neuraminidase__InfluenzaA__AJJ98827
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgguauccuggugucagaugugucugcagagacaacuggaaaggcuccaauaggcccaucguagauauaaacauaaaggaucauaacauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56383 - RNA, 1410 nt, Artificial Sequence
  neuraminidase__InfluenzaA__AJJ98839
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagaaauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaauggaacuuguacaguaguaaugacugaugggagugcuucaggaaaagcugauaccaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 56384 - RNA, 1410 nt, Artificial Sequence
  neuraminidase__InfluenzaA__AJJ98851
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauagacccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56385 - RNA, 1410 nt, Artificial Sequence
  neuraminidase__InfluenzaA__AJJ98863
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugagaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcauuuguaucaauggaacuuguacaguaguaaugacugauggaagugcuucaggaaaagcugauacuaaaauacuauucauugaggagggaaaaaucguucauacuagcacauugucaggaagugcucagcaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcacuucagguacauauggaacaggcucauggccugauggggcggacaucaaucucaugccuauauaa

SEQ ID NO: 56386 - RNA, 1410 nt, Artificial Sequence
  neuraminidase__InfluenzaA__AJJ98875
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56387 - RNA, 1410 nt, Artificial Sequence
  neuraminidase__InfluenzaA__AJJ98887
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuauguaucaugcgauccugacaaguguuaucaauuugcccuuggacagggaacaacacuaaacaacgugcauucaaauaacacaguacguaauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguagaguugauaaggggaagaaaagaggaaacugacgucuuguggaccucaaacaguauuguuguguuuuguggcaccucagguacauauggaacaggcucauggccugauggggcagacaucaaucucaugccuauauaa

SEQ ID NO: 56388 - RNA, 1410 nt, Artificial Sequence
  neuraminidase__InfluenzaA__AJJ98899
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaauuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacguaauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggauggggagaacgaucagcgagaagucacgcuuaggguaugaaaccuucaaagucauugaaggcugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56389 - RNA, 1410 nt, Artificial Sequence
  neuraminidase__InfluenzaA__AJJ98911
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaauaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaccuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaauccuaaguccaaauugcagauaaauaggcaagucauaguugacagaggugauagguccgguuauucugguauuuucucuguugaaggcaaaagcugcaucaaucggugcuuuuauguagaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56390 - RNA, 1410 nt, Artificial Sequence; identical to SEQ ID NO: 55218
  neuraminidase__InfluenzaA__AJJ98923

SEQ ID NO: 56391 - RNA, 1410 nt, Artificial Sequence
  neuraminidase__InfluenzaA__AJJ98935
augaauccaaaucaaaagauaauaacgauuggcucuguuucucucaccauuuccacaauaugcuucuucaugcaaauugccaucuugauaacuacuguaacauugcauuucaagcgauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacucaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucuguagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56392 - RNA, 1410 nt, Artificial Sequence
  neuraminidase__InfluenzaA__AJJ98947
augaauccaaaucaaaagauaauaacgauuggcucuguuucucucaccauuuccacaauaugcuucuucaugcaaauugccauuuugauaacuacuguaacauugcauuucaagcaauaugaauucaacucccccccaaacaaccaagugacgcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacggggaaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56393 - RNA, 1410 nt, Artificial Sequence
  neuraminidase__InfluenzaA__AJJ98971
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56394 - RNA, 1410 nt, Artificial Sequence
  neuraminidase__InfluenzaA__AJJ98995
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacauaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaacaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56395 - RNA, 1410 nt, Artificial Sequence; identical to SEQ ID NO: 51699
  neuraminidase__InfluenzaA__AJJ99007

SEQ ID NO: 56396 - RNA, 1410 nt, Artificial Sequence
  neuraminidase__InfluenzaA__AJJ99019
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaauuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuuggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 56397 - RNA, 1410 nt, Artificial Sequence
  neuraminidase__InfluenzaA__AJJ99031
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacaauaaacaacgugcauucaaaugacacaguacgugauaggaccccuuaucggacccuauugaugaaugaguuaggugucccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56398 - RNA, 1410 nt, Artificial Sequence
  neuraminidase__InfluenzaA__AJJ99043
augaacccaaaucaaaagauaauaacgauuggcucuguuucucucaccauuuccacaauaugcuucuucaugcaaauugccaucuuaauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaauauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacagugguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggagaggcuccaauaggcccauaguagauauaaacaugaaggauuauagcauuguuuccaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaauccuaauuccaaauugcagauaaauagacaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56399 - RNA, 1410 nt, Artificial Sequence
  neuraminidase__InfluenzaA__AJJ99067
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugguaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56400 - RNA, 1410 nt, Artificial Sequence
  neuraminidase__InfluenzaA__AJJ99079
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacguaauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucgcgcuuaggguaugaaaccuucaaagucauugaaggcugguccaacccuaaauccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56401 - RNA, 1410 nt, Artificial Sequence
  neuraminidase__InfluenzaA__AJJ99091
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacuuguggaugggaagaacaaucaacgagacgucacgcuuaggguaugaaaccuucaaagucauugaaggcugguccaacccuaaauccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56402 - RNA, 1410 nt, Artificial Sequence
  neuraminidase__InfluenzaA__AJJ99103
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacguaauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauucucaggacccaggaaucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaacaggcccaucguagauauaaacauaaaagaucauagcauuguuuccaguuauguguguucaggacuuguuggagacacacccagaaaaaacgacagcucaagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaagugauagguccgguuauucugguauuuucucuguugaaggcaaaaguugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56403 - RNA, 1410 nt, Artificial Sequence
  neuraminidase__InfluenzaA__AJJ99115
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacggggaaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56404 - RNA, 1410 nt, Artificial Sequence
  neuraminidase__InfluenzaA__AJJ99127
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguccauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56405 - RNA, 1410 nt, Artificial Sequence
  neuraminidase__InfluenzaA__AJJ99139
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccacacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccaguaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56406 - RNA, 1410 nt, Artificial Sequence
  neuraminidase__InfluenzaA__AJJ99151
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaccugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaauguacauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugaugggaaugacguguggaugggaagaacgaucagcgagaagucacgcuuaggguaugaaaccuucaaagucauugaaggaugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56407 - RNA, 1410 nt, Artificial Sequence
  neuraminidase__InfluenzaA__AJJ99163
augaauccaaaucaaaagauaauaacgauuggcucuguuucucucaccauuuccacaauaugcuucuucaugcaaauugccaucuugauaacuacuguaacauugcauuucaagcaauaugaauuuaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauaccagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaauaaugaagaagguggucauggagugaaaggcugggccuuugaugaugggaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucgaacaguauuguuguguuuuguggcaccucagguacauauggaacaggcucauggccugauggggcggacaucaaucucaugccuauauaa

SEQ ID NO: 56408 - RNA, 1410 nt, Artificial Sequence
  neuraminidase__InfluenzaA__AJJ99175
augaauccaaaucaaaagauaauaacgauuggcucuguuucucucaccauuuccacaauaugcuuauucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggaugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugaugggacggacaucaaucucaugccuauauaa

SEQ ID NO: 56409 - RNA, 1410 nt, Artificial Sequence
  neuraminidase__InfluenzaA__AJJ99199
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauucgcccuuggacagggaacaacacuaaacaaugugcauucaaaugacacaguacguaauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacagugguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56410 - RNA, 1410 nt, Artificial Sequence
  neuraminidase__InfluenzaA__AJJ99211
augaauccaaaucaaaagauaauaacgauuggcucuguuucucucaccauuuccacaauaugcuucuucaugcaaauugccaucuuaauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaauauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaaugacacaguacgugauaggaccccuuaucggacucuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggagaggcuccaauaggcccauaguagauauaaacaugaaggauuauagcauugucuccaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56411 - RNA, 1410 nt, Artificial Sequence
  neuraminidase__InfluenzaA__AJJ99223
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggacccuaacaaugaagaagguggucauggagugaaaggcugggccuuugaugauggaaaugacgugugggugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56412 - RNA, 1410 nt, Artificial Sequence
  neuraminidase__InfluenzaA__AJJ99235
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaaugacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggagggaaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggacccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56413 - RNA, 1410 nt, Artificial Sequence
  neuraminidase__InfluenzaA__AJJ99246
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaaacgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggagaaacaauauauugagaacacaagagucugaaugugcauguuuaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaguggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56414 - RNA, 1410 nt, Artificial Sequence
  neuraminidase__InfluenzaA__AJJ99257
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugaaucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccagugccgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaacaaaugaguggucaggauauagcgggaguuuuguucagcauccagaacuaacagggcuggacuguauaagaccuugcuucuggguugaacuaaucagagggcgacccaaagagaacacaaucuggacuagugggagcagcauauccuuuugugguguaaacaguggcacuguggguuggucuuggccagacggugcugaguugccauuuaccauugacaaguaa

SEQ ID NO: 56415 - RNA, 1413 nt, Artificial Sequence
  neuraminidase__InfluenzaA__AJJ99269
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcaggagaggacaaaacuucagugacauuggccggcaauucgucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugaucugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaauuggucuuggccagacggugcugaguugccguucaccauugacaaguag

SEQ ID NO: 56416 - RNA, 1410 nt, Artificial Sequence; identical to SEQ ID NO: 51462
  neuraminidase__InfluenzaA__AJJ99280

SEQ ID NO: 56417 - RNA, 1410 nt, Artificial Sequence; identical to SEQ ID NO: 51309
  neuraminidase__InfluenzaA__AJJ99291

SEQ ID NO: 56418 - RNA, 1413 nt, Artificial Sequence
  neuraminidase__InfluenzaA__AJJ99303
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggcuggcaauucaucucuuuguuccaucaguggaugggcuauauacacaaaagacaacagcauaagaauuggcuccaaaggagauguuuuuguaauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccacgacggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauggaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucgggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56419 - RNA, 1410 nt, Artificial Sequence
  neuraminidase__InfluenzaA__AJJ99314
augaauccaaaccaaaagauaauaaccauugguucggccuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguagggauaaaugaguggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 56420 - RNA, 1413 nt, Artificial Sequence
  neuraminidase__InfluenzaA__AJJ99326
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcuugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56421 - RNA, 1410 nt, Artificial Sequence
  neuraminidase__InfluenzaA__AJJ99337
augaauccaaaccaaaagauaauaaccauuaguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56422 - RNA, 1410 nt, Artificial Sequence
  neuraminidase__InfluenzaA__AJJ99348
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugagaacaacacuuggguaaaucagacauauguuaacaucagcaacaccaacuuugcugcuggacagucagugguuuccaugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacgguaaugguguuuggauaggaagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56423 - RNA, 1410 nt, Artificial Sequence
  neuraminidase__InfluenzaA__AJJ99359
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaacuuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56424 - RNA, 1410 nt, Artificial Sequence
  neuraminidase__InfluenzaA__AJJ99370
augaauccaaaccaaaagauaauaaccauugguucggucugcaugauaauuggaauggcuaacuuaauauuacaaauuggaaacauaaucucaauauggauuagccacucaauucaacuuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauagacaggccucauacaagaucuucagaauagaaaagggaaagauagucaaaucggucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56425 - RNA, 1410 nt, Artificial Sequence; identical to SEQ ID NO: 51094
  neuraminidase__InfluenzaA__AJJ99381

SEQ ID NO: 56426 - RNA, 1410 nt, Artificial Sequence
  neuraminidase__InfluenzaA__AJJ99392
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuggcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgccuaauggagcaaauggaguaaaaggauuuucauucaaauacggcaaugguguuuggauagggagaacuaaaagcauuaguucaagaaacggguuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcuaaguugccauuuaccauugacaaguaa

SEQ ID NO: 56427 - RNA, 1410 nt, Artificial Sequence; identical to SEQ ID NO: 47242
  neuraminidase__InfluenzaA__AJJ99403

SEQ ID NO: 56428 - RNA, 1413 nt, Artificial Sequence
  neuraminidase__InfluenzaA__AJJ99415
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauaucaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuacagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaauguguuuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56429 - RNA, 1413 nt, Artificial Sequence
  neuraminidase__InfluenzaA__AJJ99427
augaacccaaaucaaaagauaauaaccauuggaucaaucaguauagcaaucggaauaauuagucuaauguugcaaauagggaauauuauuucaauaugggcuagucacucaauccaaacugggagucaaaacaacacuggaauaugcaaccaaagaaucaucacauacgaaaacagcaccugggugaaucacacauauguuaauauuaacaacacuaauguuguugcuggagaggacaaaacaucagugacauuggccggcaauucaucucuuuguucuaucaguggaugggcuguauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucugcaugaaugggucauguuucaccauaaugaccgauggcccgagugauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggauaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56430 - RNA, 1413 nt, Artificial Sequence
  neuraminidase__InfluenzaA__AJJ99439
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaccaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56431 - RNA, 1413 nt, Artificial Sequence
  neuraminidase__InfluenzaA__AJJ99451
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaauaggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56432 - RNA, 1413 nt, Artificial Sequence; identical to SEQ ID NO: 56415
  neuraminidase__InfluenzaA__AJJ99463

SEQ ID NO: 56433 - RNA, 1410 nt, Artificial Sequence
  neuraminidase__InfluenzaA__AJJ99474
augaauccaaaccaaaagauaauaaccauugguucggucuguaugacaauuggaauagcuaacuuaauauuacaaauuggaaacauaaucucaauauggauuagccacucaauucaacuugggaaucaaaaucagauugaaacaugcaaucaaagcgucauuaucuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucgagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugguauuuucggagacaauccacgcccuaaugauaagacaggcaguugugguccagugucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagugggagcagcauauccuuuugugguguaaacaguggcacuguggguuggucuuggccagacggugcugaguugccauuuaccauugacaaguaa

SEQ ID NO: 56434 - RNA, 1410 nt, Artificial Sequence; identical to SEQ ID NO: 51309
  neuraminidase__InfluenzaA__AJJ99496

SEQ ID NO: 56435 - RNA, 1410 nt, Artificial Sequence
  neuraminidase__InfluenzaA__AJJ99507
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacgacaaugguguuuggauagggagaacuaaaagcauuaguucaagaaacgguuuugagaugauuugggauccgaacggauggacugggacagacaaugacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56436 - RNA, 1410 nt, Artificial Sequence
  neuraminidase__InfluenzaA__AJJ99518
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugggccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56437 - RNA, 1410 nt, Artificial Sequence
  neuraminidase__InfluenzaA__AJJ99529
augaauccaaaccaaaagauaauaaccauugguucggucuguaugacaauuggaauggcuaacuuaauauuacaaguuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaauuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucgagauuugagucagucgcuuggucagcaagugcuugucaugauggcuucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaauuuggacuagugggagcagcauauccuuuugugguguaaacaguggcacuguggguuggucuuggccagacggugcugaguugccauuuaccauugacaaguaa

SEQ ID NO: 56438 - RNA, 1410 nt, Artificial Sequence
  neuraminidase__InfluenzaA__AJJ99540
augaauccaaaccaaaagauaauaaccauugguucggucuguaugacaauuggaauggcuaacuuaauauuacaaauuggaaacauaaucucaauauggauuagccacucaauucaacucgggaaucaaaaucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucacccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucaguugcuuggucagcaagugcuugucaugauggcaucaauuggcuaacaauuggaauuucugguccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucaguugaaaugaaugccccuaauuaucacuaugaggaaugcuccuguuauccugauucuaguaaaaucacaugugugugcagggauaacuggcauggcucaaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcauuuggauagggagaacuaaaagcauuaguucaagaaaagguuuugagaugauuugggacccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauucaccauugacaaguaa

SEQ ID NO: 56439 - RNA, 1410 nt, Artificial Sequence
  neuraminidase__InfluenzaA__AJJ99551
augaauccaaaccaaaagauaauaaccauugguucggucuguaugacaauuggaauggcuaacuuaauauuacaaauuggaaacauaaucucaauauggauuagccacucaauucaacuugggaaucaaagucagaccgaaacaugcaaucaaagcgucauuacuuaugaaaacaacacuuggguaaaucagacauauguuaacaucagcaacaccaacccugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccuccuuggaaugcagaaccuucuucuugacucaaggggccuugcuaaaugacaaacauuccaauggaaccauuaaagacaggagcccauaucgaacccuaaugagcuguccuauuggugaaguucccucucccuacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauauauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56440 - RNA, 1410 nt, Artificial Sequence; identical to SEQ ID NO: 55649
  neuraminidase__InfluenzaA__AJJ99562

SEQ ID NO: 56441 - RNA, 1410 nt, Artificial Sequence
  neuraminidase__InfluenzaA__AJJ99573
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauauaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagaugucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56442 - RNA, 1410 nt, Artificial Sequence
  neuraminidase__InfluenzaA__AJJ99584
augaauccaaaccaaaagauaauaaccauugguucggccuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggaaaugguguuuggauagggagaacuaaaagcauuaguucaagaaacgguuuugagaugauuugggauccgaacggauggacugggacagacaauaacuucucaauaaagcaagauaucguagggauaaaugaguggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 56443 - RNA, 1410 nt, Artificial Sequence
  neuraminidase__InfluenzaA__AJJ99595
augaauccaaaccaaaagauaauaaccauugguucggucuguaugacaauuggaauggcuaacuuaauauuucaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56444 - RNA, 1410 nt, Artificial Sequence
  neuraminidase__InfluenzaA__AJJ99606
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56445 - RNA, 1413 nt, Artificial Sequence
  neuraminidase__InfluenzaA__AJJ99618
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuacuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaaacaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggagaaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56446 - RNA, 1413 nt, Artificial Sequence
  neuraminidase__InfluenzaA__AJJ99630
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucaaugaaacagaauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56447 - RNA, 1413 nt, Artificial Sequence; identical to SEQ ID NO: 50289
  neuraminidase__InfluenzaA__AJJ99642

SEQ ID NO: 56448 - RNA, 1413 nt, Artificial Sequence; identical to SEQ ID NO: 50289
  neuraminidase__InfluenzaA__AJJ99654

SEQ ID NO: 56449 - RNA, 1413 nt, Artificial Sequence
  neuraminidase__InfluenzaA__AJJ99666
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacaauaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggggcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugaucugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56450 - RNA, 1410 nt, Artificial Sequence
  neuraminidase__InfluenzaA__AJJ99677
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucgagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugacugauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccagugucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaaugaaugaguggucaggauauagcgggaguuuuguucagcauccagaacuaacagggcuggacuguauaagaccuugcuucuggguugaacuaaucagagggcgacccaaagagaacacaaucuggacuagugggagcagcauauccuuuugugguguaaacaguggcacuguggguuggucuuggccagacggugcugaguugccauuuaccauugacaaguaa

SEQ ID NO: 56451 - RNA, 1410 nt, Artificial Sequence
  neuraminidase__InfluenzaA__AJJ99688
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucgagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccagugucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagugggagcagcauauccuuuugugguguaaacaguggcacuguggguuggucuuggccagacggugcugaguugccauuuaccauugacaaguaa

SEQ ID NO: 56452 - RNA, 1410 nt, Artificial Sequence
  neuraminidase__InfluenzaA__AJJ99710
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuaguaaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggacccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56453 - RNA, 1410 nt, Artificial Sequence
  neuraminidase__InfluenzaA__AJJ99721
augaauccaaaccaaaagauaauaaccauugguucggucugcaugacaauuggaauggcuaacuuaauauugcaaauuggaaacauaaucucaauauggauuagccacucaauucaacuuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagguuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56454 - RNA, 1410 nt, Artificial Sequence
  neuraminidase__InfluenzaA__AJJ99732
augaauccaaaccaaaagauaauaaccauugguucggucugcaugacaauuggaauggcuaacuuaauauuacaaauuggaaacauaaucucaauauggauuagccacucaauucaacuuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56455 - RNA, 1410 nt, Artificial Sequence; identical to SEQ ID NO: 51461
  neuraminidase__InfluenzaA__AJJ99743

SEQ ID NO: 56456 - RNA, 1410 nt, Artificial Sequence
  neuraminidase__InfluenzaA__AJJ99754
augaauccaaaccaaaagauaauaaccauugguucggucuguaugacaauuggaauggcuaacuuaauacuacaaauuggaaacauaaucucaauauggauuagccacucaauucaacuugggaaucaaaaucagauugaaacaugcaaucaaagcgucauuacuuaugaaaacaaaacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggacccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56457 - RNA, 1410 nt, Artificial Sequence
  neuraminidase__InfluenzaA__AJJ99765
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcuacuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaggacaggaguccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguguccuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56458 - RNA, 1413 nt, Artificial Sequence
  neuraminidase__InfluenzaA__AJJ99777
augaacccaaaucaaaagauaauaaccauuggaucaaucaguauagcaaucggaauaauuagucuaauauugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaacccuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaccgaccuugggugucuuuuaaucaaaacuuggauuaucaaauaggauacaucugcaguggaguguuuggugacaauccgcgucccgaagauggggagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuggucagagggcugccuagagaaaauacagcagucuggacuagugggagcagcauuucuuuuuguggcguuaauagugauacugcaaacuggucuuggccagacggugcugaguugccguucaccauugacaaguag

SEQ ID NO: 56459 - RNA, 1410 nt, Artificial Sequence; identical to SEQ ID NO: 47242
  neuraminidase__InfluenzaA__AJJ99788

SEQ ID NO: 56460 - RNA, 1413 nt, Artificial Sequence
  neuraminidase__InfluenzaA__AJJ99800
augaacccaaaucaaaagauaauaaccauuggaucaaucaguauagcaaucggaauaauuagucuaauguugcaaauaggaaauauuauuucaauaugggcuagucacucaauucaaacugggagucaaaacaacacuggaauaugcaaccaaaggaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaucauugacaaguag

SEQ ID NO: 56461 - RNA, 1413 nt, Artificial Sequence
  neuraminidase__InfluenzaA__AJJ99812
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucccuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuuccuuuuguggcguuaauagugauacugcaaacuggucuuggccagacggugcugaguugccguucaccauugacaaguag

SEQ ID NO: 56462 - RNA, 1413 nt, Artificial Sequence
  neuraminidase__InfluenzaA__AJJ99824
augaacccaaaucaaaagauaauaaccauuggaucaaucaguauagcaaucggaacaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauaugucaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccuuucaccauugacaaguag

SEQ ID NO: 56463 - RNA, 1410 nt, Artificial Sequence; identical to SEQ ID NO: 56451
  neuraminidase__InfluenzaA__AJJ99835

SEQ ID NO: 56464 - RNA, 1410 nt, Artificial Sequence
  neuraminidase__InfluenzaA__AJJ99846
augaauccaaaccaaaagauaauaaccauugguucggucugcaugacaauuggaauggcuaacuuaauauugcaaauuggaaacauaaucucaauauggauuagccacucaauucaacuuggaaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucaacauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56465 - RNA, 1410 nt, Artificial Sequence; identical to SEQ ID NO: 51094
  neuraminidase__InfluenzaA__AJJ99857

SEQ ID NO: 56466 - RNA, 1410 nt, Artificial Sequence
  neuraminidase__InfluenzaA__AJJ99868
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaaggaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuaguguaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaaaauaucguaggaauaaaugaguggucaggauauagcgggaguuuuguccagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56467 - RNA, 1410 nt, Artificial Sequence; identical to SEQ ID NO: 53350
  neuraminidase__InfluenzaA__AJJ99879

SEQ ID NO: 56468 - RNA, 1410 nt, Artificial Sequence; identical to SEQ ID NO: 47242
  neuraminidase__InfluenzaA__AJJ99890

SEQ ID NO: 56469 - RNA, 1410 nt, Artificial Sequence
  neuraminidase__InfluenzaA__AJJ99901
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaccaaagcgucauuacuuaugaaaacaacacuuggguaaaucagacauauguuaacaucagcaacaccaacuuugcagcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaaaaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauaucuuuuugugguguagacaguggcacuguggguuggucuuggccagacggugcugaguugccauuuaccauugacaaguaa

SEQ ID NO: 56470 - RNA, 1410 nt, Artificial Sequence
  neuraminidase__InfluenzaA__AJJ99912
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuaguaaaaucacaugugugugcagggauaacuggcauggcucgaaucgaccgugggugucuuucaaccagaaucuggaauaucagauaggauacauaugcagugggauuuucggagacaauccacgcccuaaagauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggacccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56471 - RNA, 1410 nt, Artificial Sequence
  neuraminidase__InfluenzaA__AJJ99923
augaauccaaaccaaaagauaauaaccauugguucggucuguaugacaauuggaauggcuaacuuaauauuacaaauuggaaacauaaucucaauauggauuagccacucaauucaacuugguaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauaggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56472 - RNA, 1410 nt, Artificial Sequence; identical to SEQ ID NO: 51309
  neuraminidase__InfluenzaA__AJJ99934

SEQ ID NO: 56473 - RNA, 1410 nt, Artificial Sequence; identical to SEQ ID NO: 51094
  neuraminidase__InfluenzaA__AJJ99945

SEQ ID NO: 56474 - RNA, 1410 nt, Artificial Sequence
  neuraminidase__InfluenzaA__AJJ99956
augaauccaaaucaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccccuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguauugucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggagacccaaagagaacacaaucuggacuagcgggagcagcauauccuuuugugguguaaacagugacacuguggguuggucuuggccagacggugcugaguugccguuuaccauugacaaguaa

SEQ ID NO: 56475 - RNA, 1410 nt, Artificial Sequence; identical to SEQ ID NO: 48286
  neuraminidase__InfluenzaA__AJJ99967

SEQ ID NO: 56476 - RNA, 1413 nt, Artificial Sequence
  neuraminidase__InfluenzaA__AJJ99991
augaacccaaaucaaaagauaauaaccauuggaucaaucaguauagcaaucggaauaaucagucuaauguugcaaauaggaaauauuauuucaauaugggcuagucacucaauccaaacuggaagucaaaacaacacuggaauaugcaaccaaagaaucaucacauaugaaaacugcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccacuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaauuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56477 - RNA, 1410 nt, Artificial Sequence
  neuraminidase__InfluenzaA__AJK00003
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucgagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuuuggagacaauccacgcccuaaugauaagacaggcaguugugguccagugucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagugggagcagcauauccuuuugugguguaaacaguggcacuguggguuggucuuggccagacggugcugaguugccauuuaccauugacaaguaa

SEQ ID NO: 56478 - RNA, 1410 nt, Artificial Sequence
  neuraminidase__InfluenzaA__AJK00014
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcagcuggacagucagugguuucugugaaauuagcgggcaauuccucucucugcccuguuagugggugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugaguccgucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucaugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaacaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccagacggugcugaguugccauuuaccauugacaauuaa

SEQ ID NO: 56479 - RNA, 1410 nt, Artificial Sequence
  neuraminidase__InfluenzaA__AJK00025
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccagugucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagugggagcagcauauccuuuugugguguaaacaguggcacuguggguuggucuuggccagacggugcugaguugccauuuaccauugacaaguaa

SEQ ID NO: 56480 - RNA, 1410 nt, Artificial Sequence
  neuraminidase__InfluenzaA__AJK00036
augaauccaaaccaaaagauaauaaccauugguucggucugcaugacaauuggaauggcuaacuuaauauuacaaauuggaaacauaaucucaauauggauuagccacucaauucaacuuggaaaucaaagucagauugaaacaugcaaucaaagcgucauuacuuaugaaaacaacacuuggguaaaucagacauauguuaacaucagcaacaucaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56481 - RNA, 1410 nt, Artificial Sequence
  neuraminidase__InfluenzaA__AJK00047
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauacguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucauguucccccuuggaaugcaggaccuucuucuugacucaaggggccuugcuaaaugacaaacauuccaauggaaccauuaaagacaggagcccauaucgaacucuaaugagcuguccuauuggugaaguucccucuccauacaacucaagauuugaaucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggggacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaguaaagcaagauaucauaggaauaaaugaguggucaggauauagcgggaguuuuguucagcauccagaacuaacagggcuggauuguauaagaccuugcuucuggguugagcuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 56482 - RNA, 1410 nt, Artificial Sequence; identical to SEQ ID NO: 51461
  neuraminidase__InfluenzaA__AJK00058

SEQ ID NO: 56483 - RNA, 1410 nt, Artificial Sequence
  neuraminidase__InfluenzaA__AJK00069
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauuuuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56484 - RNA, 1413 nt, Artificial Sequence; identical to SEQ ID NO: 50289
  neuraminidase__InfluenzaA__AJK00081

SEQ ID NO: 56485 - RNA, 1413 nt, Artificial Sequence; identical to SEQ ID NO: 56415
  neuraminidase__InfluenzaA__AJK00093

SEQ ID NO: 56486 - RNA, 1413 nt, Artificial Sequence
  neuraminidase__InfluenzaA__AJK00105
augagcccaaaucaaaagauaauaaccauuggaucaaucaguauagcaaucggaauaauuagucuaauguugcaaauaggaaauacuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcaggagaggacaaaacuucagugacauuggccggcaauucgucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucuuacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugaucugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaauuggucuuggccagacggugcugaguugccguucaccauugacaaguag

SEQ ID NO: 56487 - RNA, 1410 nt, Artificial Sequence
  neuraminidase__InfluenzaA__AJK00116
augaauccaaaccaaaagauaauaaccauugguucggucuguaugacaauuggaauggcuaacuuaauauuacaaauugggaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccccuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaggauagaaaagggaaagauagucaaaucagucgaaaugaaugccccuaauuaucacuaugaggaaugcuccuguuauccugauucuagugaaaucacaugugugugcagggauaacuggcauggcucaaaucgaccgugggugucuuucaaccagaaucuggaauaucagauaggauacauaugcagugggauuuucggagacaauccacgcccuaaugauaagaaagguaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56488 - RNA, 1410 nt, Artificial Sequence; identical to SEQ ID NO: 56422
  neuraminidase__InfluenzaA__AJK00127

SEQ ID NO: 56489 - RNA, 1410 nt, Artificial Sequence
  neuraminidase__InfluenzaA__AJK00138
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaaucggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56490 - RNA, 1350 nt, Artificial Sequence
  neuraminidase__InfluenzaA__AJK00152
augaauccaaaucaaaagauaauaaccauuggaucaaucuguaugguaacuggaauaguuagcuuaaugcuacagauugggaacauaaucucaaugugggucagucauucaauucaaacaaggaaucaacaccaaacugaaccaaucagaaauacuaauuuucuuacugagaacgcuguggcuucaguaacauuagcgggcaauucgucucuuugccccauuagaggaugggcuguacacaguaaagacaacaguauaaggauugguuccaagggggauguguuuguaauuagagagccguucaucucaugcucccauuuggaaugcagaacuuucuuuuugacccagggagcauuaauaaaugacaagcacuccaacgggacugucaaagacagaagcccucacagaacacuaaugaguugcccugugggugaggcucccuccccauauaacucaagguuugagucuguugcuuggucagcaagugcuugccaugauggcaccaguuggcugacaauuggaauuucugguccagacaauggggcgguggcuguauugaaauacaacggcauaauaacagacaccaucaagaguuggaggaacaacauacugagaacucaagagucugaaugugcauguguaaauggcucuugcuuuacuguaaugacugacggaccaaguaauggacaggcaucauauaagaucuucaaaauggaaaaagggaaaguaguuaaaucagucgaauugaaugcuccuaauuaucacuaugaggaaugcuccuguuauccugaugcuggagaaaucacaugugugugcagggauaauuggcauggcucaaauaggccauggguaucuuucaaucagaauuuggaguaucaaauaggauacauaugcaguggaguuuucggagacaauccacgccccaaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaaugguuggacuggaacggacagugacuuuucggugaaacaagauauaguagaaauaacugauuggucaggauauagcgggaguuuuguccagcauccagaacugacaggauuagauugcauaagaccuugcuucuggguugaguugaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 56491 - RNA, 1350 nt, Artificial Sequence
  neuraminidase__InfluenzaA__AJK00167
augaauccaaaucagaagauaauaaccauugggucaaucuguaugguaauuggaauaguuagcuuaauguuacaaauugggaacaugaucucaauaugggucagucauucaauucaaacagggaaucaacaccaagcugaaccaaucagaaaugcuaauuuucuuacugagaacgcuguggcuucaguaacauuagcgggcaauucaucucuuugccccguuagaggaugggcuguacacaguaaagacaacaguauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaaugguauaauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggagaaagggaaagugguuaaaucagucgaauugaaugcuccuaauuaucacuaugaggaaugcuccuguuauccugaugcuggcgaaaucacaugugugugcagggauaauuggcauggcucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucggaagaaccaaaagcacuaauuccaggagcggcuuugaaaugauuugggauccaaauggguggacugaaacggacaguaacuucucggugaaacaagauauaguagcaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 56492 - RNA, 1350 nt, Artificial Sequence
  neuraminidase__InfluenzaA__AJK00178
augaauccaaaucaaaagauaauaaccauugggucaaucuguaugguaauuggaauaguuagcuuaauguugcaaauugggaacaugaucucaauaugggccagucacucaauucggacagggaaucaaaaccaaguugagccaaucaucaauacuaauuuucccaccgagaaagccgcggcuucaauaacauuagcgggcaauucaucucuuugcccuauuagagggugggcuauacacaguaaggacaacaguauaaggauugguuccaagggggauguguuuguuauuagagagccauucaucucaugcucucacuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugagucuguugcuuggucagcaagugcuugccaugauggcaccaguugguuaacaauuggaauuucuggcccggacaauggggcuguggcuguauugaaauacaauggcauaauaacagacaccaucaagaccuggaggaacaacauauugagaacucaagaguccgaaugugcaugcguaaauggcucuugcuuuacuguaaugacugacggaccaagugaugggcaggcaucauauaagaucuucaaaauggaaaaaggaaaaguaauuaaaucaguugaauuggaugcuccuaauuaccacuaugaggaaugcuccuguuauccugaugccggugaaaucacaugugugugcagagacaauuggcauggcucaaaucggccauggguguccuucaaucaaaaucuggaguaucaaauaggguauauaugcaguggaguuuucggagacaauccacgcccuacugauggaacagguaguugugguccggugucccauaauggggcauaugggguaaaaggguuuucauuuaaauacggcaaugguguuuggaucgggagaaccaaaagcccuaauuccaggagcgguuuugaaaugauuugggauccaaauggguggagugaaacggacaguagcuucucggugaaacaagauauaguagcaauaaccgauuggucaggauauagcgggaguuuuguccagcauccagaacugacagguuuagauugcauaagaccuuguuucuggguugaguuaaucagagggcggcccaaagagaguacaguuuggacuagugggagcagcauauccuuuugugguguaaauagugacacugugaguuggucuuggccagacggugcugaguugccauucaccauugacaaguaa

SEQ ID NO: 56493 - RNA, 1350 nt, Artificial Sequence
  neuraminidase__InfluenzaA__AJK00199
augaauccaaaucaaaagauaauaaccauugggucaaucuguaugguaauuggaauaguuagcuuaauguugcaaauugggaacaugaucucaauaugggucagucauucaauucagacagggaaucaaaaccaaguugagccaaucaucaauacuaauuuucuuacugagaaagcugugguuucaauaacauuagcgggcaauucaucucuuugcccuauuagaggaugggcuauacacaguaaggacaacaguauaaggauugguuccaagggggauguguuuguuauuagagagccauucaucucaugcucucacuuggaaugcagaacuuucuuuuugacucagggagccuugcugaaugacaagcacuccaacgggacugucaaagacagaagcccucauagaacauuaaugaguuguccugugggugaggcuccuuccccauauaacucaagguuugagucuguugcuuggucagcaagugcuugccaugauggcaccaguugguugacaauuggaauuucuggcccggacaauggggcugcggcuguauugaaauacaauggcauaauaacagacaccaucaagagcuggaggaacaacauacugagaacucaagaguccgaaugugcauguguaaauggcucuugcuuuacuguaaugacugacggaccaagugaugggcaggcaucauauaagaucuucaaaauggaaaaagggaaaguaauuaaaucagucgaauuggaugcuccuaauuaccacuaugaggaaugcuccugcuauccugaugccggugaaaucacaugugugugcagagauaauuggcauggcucaaaucggccauggguguccuucaaucaaaaucuggaguaucaaauaggauauauaugcaguggaguuuucggagacaauccacgccccaaugauggaacagguaguuguaguccggugucccauaauggggcauaugggguaaaaggguuuucauuuaaauacggcaaugguguuuggaucgggagaaccaaaagcccuaauuccaggagcggcuuugaaaugauuugggauccaaauggauggagugaaacagacaguagcuucucggugaaacaagauauaguagcaauaaccgauuggucaggauauagcgggaguuuuguccagcauccagaacugacagguuuagauugcauaagaccuuguuucuggguugaguuaaucagagggcggcccaaagagaguacaguuuggacuagugggagcagcauauccuuuugugguguaaauagugacacugugaguuggucuuggccagacggugcugaguugccauucaccauugacaaguaa

SEQ ID NO: 56494 - RNA, 1350 nt, Artificial Sequence
  neuraminidase__InfluenzaA__AJK00208
augaauccaaaucaaaagauaauaaccauuggaucaaucuguaugguaacuggaauaguuagcuuaaugcuacagauugggaacauaaucucaaugugggucagucauucaauucaaacaaggaaucaacaccaaacugaaccaaucagaaauacuaauuuucuuacugagaacgcuguggcuucaguaacauuagcgggcaauucgucucuuugccccauuagaggaugggcuguacacaguaaagacaacaguauaaggauugguuccaagggggauguguuuguaauuagagagccguucaucucaugcucccauuuggaaugcagaacuuucuuuuugacccagggagcauuacugaaugacaagcacuccaacgggacugucaaagacagaagcccucacagaacacuaaugaguugcccugugggugaggcucccuccccauauaacucaagguuugagucuguugcuuggucagcaagugcuugccaugauggcaccaguuggcugacaauuggaauuucugguccagacaauggggcgguggcuguauugaaauacaacggcauaauaacagacaccaucaagaguuggaggaacaacauacugagaacucaagagucugaaugugcauguguaaauggcucuugcuuuacuguaaugacugauggaccaaguaauggacaggcaucauauaagaucuucaaaauggaaaaagggaaaguaguuaaaucagucgaauugaaugcuccuaauuaucacuaugaggaaugcuccuguuauccugaugcuggagaaaucauaugugugugcagggauaauuggcauggcucaaauaggccauggguaucuuucaaucagaauuuggaguaucaaauaggauacauaugcaguggaguuuucggagacaauccacgccccaaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaaugguuggacuggaacggacagugacuuuucggugaaacaagauauaguagaaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 56495 - RNA, 1350 nt, Artificial Sequence
  neuraminidase__InfluenzaA__AJK00219
augaauccaaaucaaaagauaauaaccauuggaucaaucuguaugguaacuggaauaguuagcuuaaugcuacagauugggaacauaaucucaaugugggucagucauucaauucaaacaaggaaucaacaccaagcugaaccaaucagaaauacuaauuuucuuacugagaacgcuguggccucaguaacauuagcgggcaauuugucucuuugccccauuagaggaugggcuguacacaguaaagacaacaauauaaggauugguuccaagggggacguguuuguaauuagagagccguucaucucaugcucccauuuggaaugcagaacuuucuuuuugacccagggagcauuacugaaugacaagcacuccaacgggacugucaaagacagaagcccucacagaacacuaaugaguugcccugugggugaggcucccuccccauauaacucaagguuugagucuguugcuuggucagcaagugcuugccaugauggcaccaguuggcugacaauuggaauuucugguccagacaauggggcgguggcuguauugaaauacaacggcauaauaacagacacaaucaagaguuggaggaacaacauacugagaacucaagagucugaaugugcauguguaaauggcucuugcuucacuguaaugacugauggaccaaguaauggacaggcaucauauaagaucuucaaaauggaaaaagggaaaguaguuaaaucagucgaauugaaugcuccuaauuaucacuaugaggaaugcuccuguuauccugaugcuggagaaaucauaugugugugcagggauaauuggcauggcucaaauaggccauggguaucuuucaaucagaauuuggaguaucaaauaggauacauaugcaguggaguuuucggcgacaauccacgccccaaugaugggacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaaugguuggacuggaacggacagugacuuuucggugaaacaagauauaguagaaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauauccuuuugugguguaaauagugacacugugaguuggucuuggccagacggugcugaguugccauucaccauugacaaguag

SEQ ID NO: 56496 - RNA, 1350 nt, Artificial Sequence
  neuraminidase__InfluenzaA__AJK00230
augaauccaaaucaaaagauaauaaccauuggaucaaucuguaugguaacuggaauaguuagcuuaaugcuacagauugggaacauaaucucaaugugggucagucauucaauucaaacaaggaaucaacaccaaacugaaccaaucagaaauacuaauuuucuuacugagaacgcuguggcuucaguaacauuagcgggcaauucgucucuuugccccauuagaggaugggcuguacacaguaaagacaacaguauaaggauugguuccaagggggauguguuuguaauuagagagccguucaucucaugcucccauuuggaaugcagaacuuucuuuuugacccagggagcauuaauaaaugacaagcacuccaacgggacugucaaagacagaagcccucacagaacacuaaugaguugcccugugggugaggcucccuccccauauaacucaagguuugagucuguugcuuggucagcaagugcuugccaugauggcaccaguuggcugacaauuggaauuucugguccagacaauggggcgguggcuguauugaaauacaacggcauaauaacagacaccaucaagaguuggaggaacaacauacugagaacucaagagucugaaugugcauguguaaauggcucuugcuuuacuguaaugacugacggaccaaguaauggacaggcaucauauaagaucuucaaaauggaaaaagggaaaguaguuaaaucagucgaauugaaugcuccuaauuaucacuaugaggaaugcuccuguuauccugaugcuggagaaaucauaugugugugcagggauaauuggcauggcucaaauaggccauggguaucuuucaaucagaauuuggaguaucaaauaggauacauaugcaguggaguuuucggagacaauccacgccccaaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaaugguuggacuggaacggacagugacuuuucggugaaacaagauauaguagaaauaacugauuggucaggauauagcgggaguuuuguccagcauccagaacugacaggauuagauugcauaagaccuugcuucuggguugaguugaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 56497 - RNA, 1380 nt, Artificial Sequence
  neuraminidase__InfluenzaA__AJS18470
augaauccaaaucaaaagauaacaugcauuucagcaacaggaguaacacuaucggugguaagucugcuaauaggaaucgccaauuugggccuaaauaucggacuacacuacaaaguggaugauucaacaacuauaaacauuccaaacaugaaugagaccaacccaacaauaacaaacaucacuaacauuauagugaauaagaacgaagaaagaacauuucucaacuugaccaagccgcuaugugaagucaacucauggcacauucuaucgaaagacaaugcaauaagaauaggugaggaugcucauauacuggucacaagggaaccuuacuuguccugugacccacaaggaugcaggauguuugcucugagucaaggcacaacacucagagggcgacaugcgaauggaaccauacaugauaggagcccauuucgagcucuuauaaguugggaaaugggucaggcacccaguccauauaauacuagggucgaaugcauaggauggucaagcacgucaugccaugauggcauaucaaggaugucaauaugcauaucaggaccgaauaacaaugcaucggcaguggugugguacagggggagaccaguaacagaaaucccaucauggguagggaacauucuuaggacucaagaaucagaaugugugugccauaaaggaaucugcccaguggucaugacagaugguccagcaaacaacaaggcagcaacuaagauaaucuacuucaaagagggaaagauacagaaaauugaagaacugcaagggaacgcucaacacgucgaagaguguucaugcuacggagcagcagggaugaucaaauguguaugccgagacaauuggaagggggcaaauagaccaauaaucacuauagaucccgaaaugaugacccacacaagcaaauacuuguguucaaaaauuuuaaccgacacaagucguccuaaugaccccaccaaugggaacugcgaugcgccaauaauaggagggagcccagacccagggguaaaaggguuugcauaccuagacggggagaauucauggcuuggaaggacaauuagcaaagacuccagaucaggcuacgaaauguuaaaggucccaaaugcagaaaccgacacucaaucagggccaaccucauaccagcugauugucaacaaccaaaauuggucaggguacucaggggcauucauagacuacugggcaaacaagggaugcuucaauccuuguuuuuauguggagcuaaucagagggagacccaaagagauugauguacuguggacuuccaauagcaugguagcucucuguggauccagggagcgauugggaucaugguccuggcaugauggugcagaaaucaucuacuuuaaguag

SEQ ID NO: 56498 - RNA, 1380 nt, Artificial Sequence
  neuraminidase__InfluenzaA__AJS18481
augaauccaaaucaaaagauaacaugcauuucagcaacaggaguaacacuaucggugguaagccugcuaauaggaaucgccaauuugggccuaaauaucggacuacacuacaaagugagugauucaacaacuauaaacaguccaaacaugaaugagaccaacccaacaacaacaaacaucacuaacauuauagugaauaagaacgaagaaagaacauuucucaauuugaccaagccgcuaugugaagucaacucauggcacauucuaucgaaagacaaugcaauaagaauaggugaggaagcucauauacuggucacaagggaaccuuacuuguccugugauccacaaggaugcaggauguuugcucugagucaaggcacaacacucagagggcgacaugcgaauggaaccauacaugauaggagcccauuucgagcucuuauaaguugggaaaugggucaggcacccagcccauauaauacuagggucgaaugcauaggauggucaagcacgucaugccaugauggcauaucaaggaugucaauaugcauaucaggaccgaauaacaaugcaucggcaguggugugguacagggggagaccaguaacagaaaucccaucaugggcagggaacauucuuaggacucaagaaucagaaugugugugccauaaaggaaucugcccaguggucaugacagacgguccagcaaacaacaaggcagcaacuaagauaauuuacuucagagagggaaagauacagaaaauugaagaacugcaagggaaugcucaacacaucgaagaguguucaugcuacggagcagcagggaugaucaaaugugcaugcagagacaauuggaagggggcaaauagaccaauaaucacuauagaucccgaaaugaugacccacacuagcaaauacuuguguucaaaaaucuuaaccgacacaagucguccuaaugaccccaccaaugggaacugcgaugcgccaguaacaggagggagcccagacccagggauaaaaggguuugcauuccuagacggggagaauucauggcuuggaaggacaauuagcaaaaacuccagaucaggcuacgaaauguuaaaggucccaaaugcagaaaccgacacucaaucagggccaaccucauaccagcugauuguaaacaaccaaaauuggucuggguacucaggggcauucauagacuacugggcaaacaaggaaugcuucaauccuuguuuuuauguggagcuaaucagagggagacccaaagagagugauguacuguggacuuccaauagcaugguagcucucuguggauccagggagcgauugggaucaugguccuggcaugauggugcagaaaucaucuacuuuaaguag

SEQ ID NO: 56499 - RNA, 1410 nt, Artificial Sequence
  neuraminidase__InfluenzaA__AKA59350
augaauccaaaccaaaagauaauaaccauugguucggucuguaugacaauuggaguggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaccagacagauguuaacaucagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucaugcuccccuuuggaaugcagaaccuucuucuugacucaaggggcauugcuaaaugacaaacauuccaauggaaccauuaaagacaggagcccauaucgaacccuaaugagcuguccuauuggugaaguucccucuccauacaacucaagauuugagucagucgcuuggucagcaagugcuugccaugauggcaucaauuggcuaacaauuggaauuucuggcccagacaauggggcaguggcgguguuaaaguacaacggcauaauaacagacacuaucaagaguuggagaaacaauauauugagaacacaagagucugaauguguauguguaaaugguucuugcuuuacuguaaugaccgauggaccaaguaauggacaggccucauacaagaucuucagaauagaaaagggaaagauaguuaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuagaauaucagauaggauacauaugcagugggauuuucggagacaauccacgcccuaaugauaagacaggcaguugugguccagugucgucuaauggagcaaauggaguaaaaggauuuucauucaaauacggcaaugguguuuggauagggagaacuaaaagcauuagcucaagaaacgguuuugagaugauuugggauccaaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacagucuggacuagcgggagcagcauauccuuuugugguguaaacagugacacuguggguuggucuuggccagacggugcugaguugccauuuaccauugacaaguaa

SEQ ID NO: 56500 - RNA, 1410 nt, Artificial Sequence
  neuraminidase__InfluenzaA__AKA59352
augaauccaaaccaaaagauaauaaccauugguucggucuguaugacaauuggaauggcuaacuuaauguuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaaccuugcuguuggacagucagugguuuccacgaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugccugucaugauggcaucaauuggcuaacaauuggaauuucugguccagacaauggggcaguggcuguguuaaaguacaacggcauaauaacagacacuaucaaaaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacgguaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauacagcgggaguuuuguucagcaucccgaacuaacagggcuagauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56501 - RNA, 1410 nt, Artificial Sequence
  neuraminidase__InfluenzaA__AKA59354
augaauccaaaccaaaagauaauaaccauugguucggucuguaugacaauuggaguggcuaacuuaauauuacaaauuggaaacauaaucucaauauggauuagccacucaauucaacuugggaaucaaaaucagauugaaacaugcaaucaaagcgucauuacuuaugaaaacaacacuugggcaaaccagacauauguuaacaucagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucaugcuccccuuuggaaugcagaaccuucuucuugacucaaggggcauugcuaaaugacaaacauuccaauggaaccauuaaagacaggagcccauaucgaacccuaaugagcuguccuauuggugaaguucccucuccauacaacucaagauuugagucagucgcuuggucagcaagugcuugccaugauggcaucaauuggcuaacaauuggaauuucuggcccagacaauggggcaguggcgguguuaaaguacaacggcauaauaacagacacuaucaagaguuggagaaacaauauauugagaacacaagagucugaauguguauguguaaaugguucuugcuuuacuguaaugaccgauggaccaaguaauggacaggccucauacaagaucuucagaauagaaaagggaaagauaguuaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuagaauaucagauaggauacauaugcagugggauuuucggagacaauccacgcccuaaugauaagacaggcaguugugguccagugucgucuaauggagcaaauggaguaaaaggauuuucauucaaauacggcaaugguguuuggauagggagaacuaaaagcauuagcucaagaaacgguuuugagaugauuugggauccaaacggauggacugagacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacagucuggacuagcgggagcagcauauccuuuugugguguaaacagugacacuguggguuggucuuggccagacggugcugaguugccauuuaccauugacaaguaa

SEQ ID NO: 56502 - RNA, 1380 nt, Artificial Sequence
  neuraminidase__InfluenzaA__AKS48026
augaauccaaaucaaaagauaacaugcauuucagcaacaggaguaacacuaucggugguaagccugcuaauaggaaucgccaauuugggccuaaauaucggacuacacuacaaagugagugauucaacaacuauaaacauuccaaacaugaaugagaccaacccaacaacaacaaacaucacuaacauuauagugaauaagaacgaagaaagaacauuucucaacuugaccaagccacuaugugaagucaacucauggcacauucuaucgaaagacaaugcaauaagaauaggugaggaugcucauauacuggucacaagggaaccuuacuuguccugugauccacaaggaugcaggauguuugcucugagucaaggcacaacacucagagggcgacaugcgaauggaaccauacaugauaagagcccauuucgagcucuuauaaguugggaaaugggucaggcacccaguccauauaauacuagggucgaaugcauaggauggucaagcacgucaugccaugauggcauaucaaggaugucaauaugcauaucaggaccgaauaacaaugcaucggcaguggugugguacagggggagaccaguaacagaaaucccaucauggguagggaacauucuuaggacucaagaaucagaauguguaugccauaaaggaaucugcccaguggucaugacagaugguccagcaaacaacaaggcagcaacuaagauaaucuacuucaaagagggaaagauacagaaaauugaagaacuacaagggaacgcucaacacaucgaagaguguucaugcuacggagcagcagggaugaucaaauguguaugcagagacaauuggaagggggcaaauagaccaauaaucacuauagaucccgaaaugaugacccacacaagcaaauacuuguguucaaaaaucuuaaccgacacaagucguccuaaugaccccaccaaugggaacugcgaugagccaauaacaggagggagcccagacccagggguaaaaggguuugcauuccuagacggggagaauucauggcuuggaaggacaauuagcaaagacuccagaucaggcuacgaaauguuaaaggucccaaaugcagaaaccgacacucaaucagggccaaccucauaccagcugauugucaacaaccaaaauuggucgggguacucaggggcauucauagacuacugggcaaacaaggaaugcuucaauccuuguuuuuauguggagcuaaucagagggagacccaaagagauugauguacugugggcuuccaauagcaugguggcucucuguggauccagggagcgauugggaucaugguccuggcaugauggugcagaaaucaucuacuuuaaguag

SEQ ID NO: 56503 - RNA, 1380 nt, Artificial Sequence
  neuraminidase__InfluenzaA__AKS48040
augaauccaaaucaaaagauaacaugcauuucagcaacaggaaugacacuaucggugguaagccugcuaauaggaaucgccaauuugggccuaaauaucggacuacacuacaaagugagugauucaacaacuauaaacauuccaaacaugaaugagaccaacccaacaacaacaaacaucacuaacauuauagugaauaagaacgaagaaagaacauuucucaacuugaccaagccacuaugugaagucaacucauggcacauucuaucgaaagacaaugcaauaagaauaggugaggaugcucauauacuggucacaagggaaccuuacuuguccugugauccacaaggaugcaggauguuugcucugagucaaggcacaacacucagagggcgacaugcgaauggaaccauacaugauaggagcccauuucgagcucuuauaaguugggaaaugggucaggcacccaguccauauaauacuagggucgaaugcauaggauggucaagcacgucaugccaugauggcauaucaaggaugucaauaugcauaucaggaccgaauaacaaugcaucggcaguggugugguacagggggagaccaguaacagaaaucccaucauggguagggaacauucuuaggacucaagaaucagaauguguaugccauaaaggaaucugcccaguggucaugacagaugguccagcaaacaacaaggcagcaacuaagauaaucuacuucaaagagggaaagauacagaaaauugaagaacuacaagggaacgcucaacacaucgaagaguguucaugcuacggagcagcagggaugaucaaauguguaugcagagacaauuggaagggggcaaauagaccaauaaucacuauagaucccgaaaugaugacccacacaagcaaauacuuguguucaaaaaucuuaaccgacacaagucguccuaaugaccccaccaaugggaacugcgaugcgccaauaacaggagggagcccagacccagggguaaaaggguuugcauuccuagacggggagaauucauggcuuggaaggacaauuagcaaagacuccagaucaggcuacgaaauguuaaaggucccaaaugcagaaaccgacacucaaucagggccaaccucauaccagcugauugucaacaaccaaaauuggucgggguacucaggggcauucauagacuacugggcaaacaaggaaugcuucaauccuuguuuuuauguggagcuaaucagagggagacccaaagagauugauguacugugggcuuccaauagcaugguggcucucuguggauccagggagcgauugggaucaugguccuggcaugauggugcugaaaucaucuacuuuaaguag

SEQ ID NO: 56504 - RNA, 1380 nt, Artificial Sequence
  neuraminidase__InfluenzaA__ALO75898
augaauccaaaucaaaagauaacaugcauuucagcaacaggaguaacacuaucggugguaagccugcuaauaggaaucgccaauuugggccuaaauaucggacuacacuacaaagugagugauucaacaacuauaaacauuccaaacaugaaugagaccaacccaacaacaacaaacaucacuaacauuauagugaauaagaacgaagaaagaacauuucucaacuugaccaagccacuaugugaagucaacucauggcacauucuaucgaaagacaaugcaauaagaauaggugaggaugcucauauacuggucacaagggaaccuuacuuguccugugauccacaaggaugcaggauguuugcucugagucaaggcacaacacucagagggcgacaugcgaauggaaccauacaugauaggagcccauuucgagcucuuauaaguugggaaaugggucaggcacccaguccauauaauacuagggucgaaugcauaggauggucaagcacgucaugccaugauggcauaucaaggaugucaauaugcauaucaggaccgaauaacaaugcaucggcaguggugugguacagggggagaccaguaacagaaaucccaucauggguagggaacauucuuaggacucaagaaucagaauguguaugccauaaaggaaucugcccaguggucaugacagaugguccagcaaacaacaaggcagcaacuaagauaaucuacuucaaagagggaaagauacagaaaauugaagaacugcaagggaacgcucaacacaucgaagaguguucaugcuacggagcagcagggaugaucaaauguguaugcagagacaauuggaagggggcaaauagaccaauaaucacuauagaucccgaaaugaugacccacacaagcaaauacuuguguucaaaaaucuuaaccgacacaagucguccuaaugaccccaccaaugggaacugcgaugcgccaauaacaggagggagcccagacccagggguaaaaggguuugcauuccuagacggggagaauucauggcuuggaaggacaauuagcaaagacuccagaucaggcuacgaaauguuaaaggucccaaaugcagaaaccgacacucaaucagggccaaccucauaccagcugauugucaacaaccaaaauuggucgggguacucaggggcauucauagacuacugggcaaacaaggaaugcuucaauccuuguuuuuauguggagcuaaucagagggagacccaaagagauugauguacugugggcuuccaauagcaugguggcucucuguggauccagggagcgauugggaucaugguccuggcaugauggugcagaaaucaucuacuuuaaguag

SEQ ID NO: 56505 - RNA, 1380 nt, Artificial Sequence
  neuraminidase__InfluenzaA__ALO75910
augaauccaaaucaaaagauaacaugcauuucagcaacaggaguaacacuaucggugguaagccugcuaauaggaaucgccaauuugggccuaaauaucggacuacacuacaaagugagugauucaacaacuauaaacauuccaaacaugaaugagaccaacccaacaacaacaaacaucacuaacauuauagugaauaagaacgaagaaagaacauuucucaacuugaccaagccacuaugugaagucaacucauggcacauucuaucgaaagacaaugcaauaagaauaggugaggaugcucauauacuggucacaagggaaccuuacuuguccugugauccacaaggaugcaggauguuugcucugagucaaggcacaacacucagagggcgacaugcgaauggaaccauacaugauaggagcccauuucgagcucuuauaaguugggaaaugggucaggcacccaguccauauaauacuagggucgaaugcauaggauggucaagcacgucaugccaugauggcauaucaaggaugucaauaugcauaucaggaccgaauaacaaugcaucggcaguggugugguacagggggagaccaguaacagaaaucccaucauggguagggaacauucuuaggacucaagaaucagaauguguaugccauaaaggaaucugcccaguggucaugacagaugguccagcaaacaacaaggcagcaacuaagauaaucuacuucaaagagggaaagauacagaaaauugaagaacuacaagggaacgcucaacacaucgaagaguguucaugcuacggagcagcagggaugaucaaauguguaugcagagacaauuggaagggggcaaauagaccaauaaucacuauagaucccgaaaugaugacccacacaagcaaauacuuguguucaaaaaucuuaaccgacacaagucguccuaaugaccccaccaaugggaacugcgaugcgccaauaacaggagggagcccagacccagggguaaaaggguuugcauuccuagacggggagaauucauggcuuggaaggacaauuagcaaagacuccagaucaggcuacgaaauguuaaaggucccaaaugcagaaaccgacacucaaucagggccaaccucauaccagcugauugucaacaaccaaaauuggucgggguacucaggggcauucauagacuacugggcaaacaaggaaugcuucaauccuuguuuuuauguggagcuaaucagagggagacccaaagagauugauguacugugggcuuccaauagcaugguggcucucuguggauccagggagcgauugggaucaugguccuggcaugauggugcagaaaucaucuacuuuaaguag

SEQ ID NO: 56506 - RNA, 1380 nt, Artificial Sequence
  neuraminidase__InfluenzaA__ALO75922
augaauccaaaucaaaagauaacaugcauuucagcaacaggaguaacacuaucggugguaagccugcuaauaggaaucgccaauuugggccuaaauaucggacuacacuacaaagugagugauucaacaacuauaaacauuccaaacaugaaugagaccaacccaacaacaacaaacaucacuaacauuauagugaauaagaacgaagaaagaacauuucucaacuugaccaagccacuaugugaagucaacucauggcacauucuaucgaaagacaaugcaauaagaauaggugaggaugcucauauacuggucacaagggaaccuuacuuguccugugauccacaaggaugcaggauguuugcucugagucaaggcacaacacucagagggcgacaugcgaauggaaccauacaugauaggagcccauuucgagcucuuauaaguugggaaaugggucaggcacccaguccauauaauacuagggucgaaugcauaggauggucaagcacgucaugccaugauggcauaucaaggaugucaauaugcauaucaggaccgaauaacaaugcaucggcaguggugugguacagggggagaccaguaacagaaaucccaucauggguagggaacauucuuaggacucaagaaucagaauguguaugccauaaaggaaucugcccaguggucaugacagaugguccagcaaacaacaaggcagcaacuaagauaaucuacuucaaagagggaaagauacagaaaauugaagaacuacaagggaacgcucaacacaucgaagaguguucaugcuacggagcagcagggaugaucaaauguguaugcagagacaauuggaagggggcaaauagaccaauaaucacuauagaucccgaaaugaugacccacacaagcaaauacuuguguucaaaaaucuuaaccgacacaagucguccuaaugaccccaccaaugggaacugcgaugagccaauaacaggagggagcccagacccagggguaaaaggguuugcauuccuagacggggagaauucauggcuuggaaggacaauuagcaaagacuccagaucaggcuacgaaauguuaaaggucccaaaugcagaaaccgacacucaaucagggccaaccucauaccagcugauugucaacaaccaaaauuggucgggguacucaggggcauucauagacuacugggcaaacaaggaaugcuucaauccuuguuuuuauguggagcuaaucagagggagacccaaagagauugauguacugugggcuuccaauagcaugguggcucucuguggauccagggagcgauugggaucaugguccuggcaugauggugcagaaaucaucuacuuuaaguag

SEQ ID NO: 56507 - RNA, 1401 nt, Artificial Sequence
  neuraminidase__InfluenzaA__ALT20083
augaauccaaaccagaggauaacagcaauuggcucugucucucuaaucauugcgauaauaugucuccucaugcagauugccaucuuaacaacgaccaugacacuacauuucaggcagaaugaaugcaguaacccaucgaauaaucaagugaugccaugugaaccaaucauaauagagaggaauacagugcauuugaauagcacuaccauagagagggaaauuuguccuaaaguagcagaauacaagaauuggucaaaaccacaaugucagauuacaggguucgccccuuuuucaaaggacaacucaauuaggcucucugcaaguggggacaucugggugacaagagaacccuaugucucaugcagucucaacaaauguuaucaauuugcacuugggcagggaaccacccugaaaaacaagcacucaaauggcacuacacaugauagaaccccucacagaacucuuuuaaugaaugaguuaggugucccauuucauuugggaaccaaacaaguaugcauagcauggucuaguucaagcugcuaugaugggaaagcaugguuacauguuuguguuacuggggaugauaaaaaugcuacugcuaguaucaucuaugaugggaugcuugucgacaguauugguucaugguccaaaaacauccucagaacucaggagucagaaugcguuugcaucaauggaacuugugcagugguaaugacugauggaagugcaucaggaaaggccgacacuagaguauuauuuauaagagaagggaaaauuauaaauauuagcccauugucaggaagugcucagcacguugaggaaugcucuuguuacccucgguauccugaaguuaggugugucugcagagacaauuggaagggcuccaauaggcccauucuauauauaaauauggcugauuauagcauugaguccaguuaugugugcucagggcuuguuggcgacacaccaagaaaugaugauagcuccagcagcagcaacugcagagacccuaauaacgaaagaggggccccaggagugaaagggugggccuuugacgacgggaaugauguuuggaugggacggacaaucaaaaaugguucacgcucagguuaugagaccuuuagggucgucaaugguuggaccauggcuaauucaaagucacagauuaauaggcaagucauaguugacaguaacgacuggucuggguauucugguaucuucucuguugaaggcaaaaaaugcaucaacagguguuuuuauguggaguugauaagagggagaccacaggaacccagagugugguggaccucaaauagcaucauuguguucuguggaaccucugguacauauggaacaggcucauggccugauggagcgaauaucaacuucaugccuauauaa

SEQ ID NO: 56508 - RNA, 1410 nt, Artificial Sequence
  neuraminidase__InfluenzaA__AMA65392
augaauccaaaccaaaagauaauaaccauugguucggucuguaugacaauuggaauggcuaacuuaauauuacaaauuggaaacauaaucucaauauggguuagccacucaauucaaauuggaaaucaaagccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaggggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauauaacucaagauuugagucaguugcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaaaaucuucagaauagaaaagggaaagauaaucaaaucagucgaaaugaaagccccuaauuaucacuaugaggaaugcuccuguuacccugauucuagugaaaucacaugugugugcagggauaacuggcauggcucgaaucgaccgugggugucuuucaaccagaaucuggaauaucagaugggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggguauagcgggaguuuuguucagcauccagaacuaacagggcuggauuguauaagaccuugcuucuggguugaacuaauaagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56509 - RNA, 1410 nt, Artificial Sequence
  neuraminidase__InfluenzaA__AMA65394
augaauccaaaccaaaagauaauaaccauugguucggucuguaugacaauuggaauggcuaacuuaauauuacaaauuggaaacauaaucucaauauggguuagccacucaauucaaauuggaaaucaaagccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaaaaucuucagaauagaaaagggaaagauaaucaaaucagucgaaaugaaagccccuaauuaucacuaugaggaaugcuccuguuacccugauucuagugaaaucacaugugugugcagggauaacuggcauggcucgaaucgaccgugggugucuuucaaccagaaucuggaauaucagaugggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggguauagcgggaguuuuguucagcauccagaacuaacagggcuggauuguauaagaccuugcuucuggguugaacuaauaagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56510 - RNA, 1410 nt, Artificial Sequence
  neuraminidase__InfluenzaA__BAA00618
augaauccaaaucaaaagauaauaacaaugggcucugucucuaucauuauugcaauaguaugcuuacucaugcagauugccauccugguaacuacuguaacauugcauuuuagacaacaugagagcgacucccccccaagcaaccaaguaauaccgugugaaccaauuauaauagaaaggaacauaacagagauaguguauuugaauaacaccaccauagagaaagagacaugccccaaaucaguggaauacagaaauuggucaaagccgcaauguaaaauuacaggguuugcaccuuuuucuaaggacaauucaauccgacuuucugcugguggggacauuugggugacgagagagccuuaugugucaugcgauccuggcaaguguuaccaauuugcacucgggcaggggaccacacuagacaauaaacauucaaaugacacaauacaugauagaaucccacaucgaacccuauugaugaaugaauuaggagucccauuccauuuaggaaccaggcaaguguguauagcgugguccagcucaaguugucacgauggaaaagcauggcugcauguuugugucacuggggaugauaaaaaugcaacugcuagcuucauuuauaacgggagacuuguggauaguauugguucauggucucaaaauauucucagaacccaggagucagaaugcguuugcaucaaugguacuugcacaguaguaaugacugaugggagugcuucagggagagccgauacuagaauacuauucauugaagagggaaaaauuguccauauuagcccguugucaggaagugcucagcauguagaggaguguucuuguuauccccgauauccugacgucagauguaucugcagagacaacuggaaaggcucuaauagcccagucguagacauaaauaugaaagauuauagcauugauuccaguuaugugugcucagggcuuguuggcgacacaccuagaaacgacgacagaucuagcaagagcaauugcaggaauccuaacaaugagagagggaaucacggagugaaaggcugggccuuugacaauggagaugacguguggaugggaagaacgaucagcaaggauuuacgcucagguuaugaaaccuuuaaagucauuggugguugguccacaccuaauuccaaaucgcagaccaauaggcaagucauaguugacagcaauaauuggucagguuauucugguauuuucucuguugagggcaaaagcugcaucaauagaugcuuuuauguggaguugauaaggggaaggaaacaggaaacuagaguaugguggacuucaaacaguauuguuguguuuuguggcacuucagguaccuauggaacaggcucauggccugauggggcgaacaucgacuucaugccuauauaa

SEQ ID NO: 56511 - RNA, 1410 nt, Artificial Sequence
  neuraminidase__InfluenzaA__BAA00619
augaauccaaaucaaaagauaauaacaauuggcucugucucucucaccuuugcagcaauaugcuuccucaugcagauugccaucuugguaacuacuguaacauugaauuucaagcaauaugaaugcgacccccccgcgaccaaccaaguaaugccgugugaaccaauaauaauagaaaggaacauaacagaaauaguguauuugacuaacaccaccauagagagagagauaugccccaaauugguggaauacaggaauuggucaaagccacaauguaaaauuacaggauuugcaccuuuuuccaaggacaauucaauucggcuuucugcugguggggacauuugggugacgagagaaccuuaugugucaugcgauccuggcagguguuaucaauuugcacucggccagggaaccacacuagacaacaaacauucaaaugacacaauacaugauagaaccccucaucgaacccuauugaugaaugaguuggguguuccauuucauuuaggaaccaggcaaguguguauagcaugguccagcucaaguugucacgauggaaaagcauggcugcaugucuguaucacuggguaugauaaaaaugcaacugcuagcuucauuuacgaugggaggcucguagacaguauugguucauggucuaaaaauauccucaggacccaggagucggaaugcguuugcaucaaugggacuuguacuguaguaaugacugauggaagugcuucaggaagagcugauacuagaauacuauucauugaagaggggagaauuguucauauuagcccauugucaggaagugcucagcauguggaggaguguuccuguuauccucgauauccuggugucagauguaucugcagagacaacuggaaaggcucuaauaggcccguaguggauauaaaugugaaagacuauagcaucaauuccaguuacgugugcucagggcuuguaggcgacacacccagaaacaacgacagaucuagcaauagcuauugccagaauccuaacaaugagaaagggaaucacggagugaaaggcugggccuuugacgauggaaaugacguguggaugggaagaacgaucagugaggauucacgcucagguuaucaaaccuucaaagucauuggcgguuggucuacaccuaacuccaaauugcagauaaauaggcaagucauaguugacagugauaauaggucagguuauucuggaauuuucucuguugagggcaaaagcugcaucaauagguguuuuuauguggagcugauaaggggaaggagacaagaaacuagaguaugguggaccucaaacaguauuguuguguuuugcggcacuucagguaccuaugggacaggcucauggccugauggggcggacaucaaucucaugccuauauaa

SEQ ID NO: 56512 - RNA, 1410 nt, Artificial Sequence
  neuraminidase__InfluenzaA__BAA00620
augaauccaaaucaaaagauaaugacaauuggcucuguaucucucaucauugcagcaguaugcuuccucaugcagauugccauccugguaacuacgguaacauugcauuuuaaacaaugugagugcgacucacccucgaacaaccaaguaaaaccgugugaaccaauaauaauagagaggaacauaacugagauaguguauuugaauaacaccaccauagagaaagagacaugccccaaguuaguugaauacagaaauuggucaaagccgcaauguaaaauuacaggauuugcaccuuuuucuaaggacaauucaauccgacuuucugcugguggggacauuuggguaacgagagagccuuaugugucgugcgauccuggcaaguguuaucaauuugcacucgggcaggggaccacacuagacaacaaacauucaaaugacacaauacaugauagaaucccacaucgaacccuauugaugaaugaauuggguguuccauuucauuuaggaaccagacaaguguguauagcaugguccagcucaaguugucacgauggaaaagcaugguugcauguuugugucacuggggaugauaaaaaugcaacugcuagcuucauuuaugacgggaggcuuguggacaguauugguucauggucucaaaauauccucaggacccaggagucggaaugcguuuguaucaaugguacuugcacaguaguaaugacugaugggagugcuucagggagagccgauacuagaauacuauucauugaagagggaaaaauuguccauauuagcccguugucaggaagugcucagcauguagaggaguguuccuguuauccucgauauccuaacgucagauguaucugcagagacaauuggaaaggcucuaauaggcccaucguagacauaaauaugaaagauuauagcauugauuccaguuauguuugcucagggcuuguuggcgacacaccuagaaacgacgacagaucuagcaagagcaauugcaggaauccuaacaaugagaaagggaaucacggagugaaaggcugggccuuugacaauggagaugacguguggaugggaagaacgaucagcaaggauuuacgcucagguuaugaaaccuuuaaagucauuggugguugguucacaccuaauuccaaaucgcaggucaauagacaagucauaguugacagcgauaaucggucagguuauucugguauuuucucuguugagggcaaaagcugcaucaauaggugcuuuuauguggaguugauaaggggaaggggacaggagacuagaguaugguggacuucaaauaguauuguuguguuuugcggcacuucagguaccuauggaaaaggcucauggccugauggggcgaauaucaacuucaugccuauauaa

SEQ ID NO: 56513 - RNA, 1410 nt, Artificial Sequence
  neuraminidase__InfluenzaA__BAA00621
augaauccaaaucaaaagauaauaacaauuggcucugucucucucaccauugcaacaauaugcuuccucaugcagauugccauccugguaacuacuguaacauugcauuucaagcaauaugagugcgacuccccagcgaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauacuagcccauugucaggaagugcucagcauguagaggaguguuccuguuacccucgauauccuggugucagauguaucugcagagacaacuggaaaggcucuaauaggccagucguagauauaaaugugaaagauuauagcauugauuccaguuaugugugcucagggcuugugggcgacacacccagaaaaaacgacagaucuagcaguagcuauugccggaauccuaacaaugaaaaagggacucacggagugaaaggaugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcaaugauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 56514 - RNA, 1413 nt, Artificial Sequence
  neuraminidase__InfluenzaA__BAA06714
augaauccaaaucagaaaauaauaaccauuggaucaaucaguauggcaaucggaauaauuagucuaauauuacaaauaggaaauauuauuucaauauggguuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaacuucagugacauuggccggcaauucaucucuuuguccuauccgugggugggcuauauacacaaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacaggagcccuuauaggcgcuuaaugagcuguccucuaggugaagcuccgucuccauacaauucaagguuugaaucgauugcuuggucagcaagcgcaugccaugauggcaugggcuggcuaacaaucggaauuucugguccagaugauggagcaguggcuguacuaaaauacaacggcauaauaacugaaaccauaaaaaguuggaagaagcgaauauuaagaacacaagagucugaaugugucuguguaaacgguucauguuuuaccauaaugaccgauggcccgaguaaugggcaggccucguacagaaucuucaaaaucgagaaggggaagguuacuaaaucaauagaguuggaugcacccaauucucauuacgaggaauguuccuguuacccagacaccggcacagugaugugugugugcagggacaauuggcacgguucgaaucgaccuugggugucuuuuaaucaaaaccuggauuaucaaauaggauacaucugcagugguguuuucggugacaauccgccucccaaagauggaaaaggcagcugugauccaguaacuguugauggagcagacggaguaaagggguuuucauacagauaugguaaugguguuuggauaggaaggacuaaaaguaacagauucagaaagggauuugagaugauuugggauccuaauggauggacagauaccgacagugauuucuuagugaaacaggauguaguggcaaugacugauuggucaggguacagcggaaguuucguucaacauccugagcuaacaggauuggacuguaugaggccuugcuucuggguugaauuagucagagggcggccuagagaaaauacaacaaucuggacuagugggagcagcauuucuuuuuguggcgugaauagugauacugcaaauuggucuuggccagacggugccgaguugccauucaccauugacaaguag

SEQ ID NO: 56515 - RNA, 1413 nt, Artificial Sequence
  neuraminidase__InfluenzaA__BAA06715
augaauccaaaucagaaaauaauaaccauuggaucaaucaguauggcaaucggaauaauuagucuaauauugcaaauaggaaauauuauuucaauaugggcuagccacucaauccaaacuggaagucaaaaccacacuggaauaugcaaccaaagaaucauuacauaugaaaauagcaccugggugaaucaaacauauguuaauauuaacaacacuaauguuguugcuggaaaggacaaaacuucagugacauuggccggcaauucaucucuuugcccuauccgugggugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcaugggcuggcuaacaaucggaauuucugguccagauaauggagcaguggcuguacuaaaauacaacggcauaauaacugaaaccauaaaaaguuggaagaagcgaauauuaagaacacaagagucugaaugugucugugugaacgguucauguuuuaccauaaugaccgauggcccgaguaauggggccgccucguacagaaucuucaaaaucgagaaggggaagguuacuaaaucaauagaguuggaugcacccaauuaucauuacgaggaauguuccuguuacccagacaccggcacagugaugugugugugcagggacaauuggcacgguucaaaucgaccuuccgugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucagugaaacaggaugucguggcaaugacugauuggucaggguacagcggaaguuucguucaacauccugagcuaacaggauuggacuguaugagaccuugcuucuggguugaauuaaucagagggcgaccuagagaaaagacaacaaucuggacuagugggagcagcauuucuuuuuguggcguaaauagcgauacugcaaacuggucuuggccagacggugccgaguugccauucaccauugacaaguag

SEQ ID NO: 56516 - RNA, 1410 nt, Artificial Sequence
  neuraminidase__InfluenzaA__BAA06716
augaauacaaaucaaagaauaauaaccauugggacaaucugucuaauaguuggaauaauuagucuauuauugcagauaggaaauauaaucuuguuauggaugagccauucaauucagacuggagaaaaaagccauccuaagguaugcaaccaaagugucauuaccuaugaaaacaacacaugggugaaccagacuuauguaaacauuagcaauaccaauauugcugcuggacagggugugacuccaauaauacuagccggcaauuccucucuuugcccaaucagugggugggcuauauacagcaaagacaauagcauaaggauugguuccaaaggagacauuuuugucaugagagagccauucauuucaugcucucacuuggaaugcagaaccuuuuuucugacccaaggcgcuuugcugaaugacaggcauucuaauggaaccgucaaggacaggaguccuuauagaaccuuaaugagcugccccaucggugaagcuccaucuccguacaauucaagguucgaaucaguugcuuggucagcaagugcaugccaugauggaaugggauggcuaacaaucgggauuuccgguccagauaauggagcaguggcuguuuuaaaauacaaugguauaauaacagauacaauaaaaaguuggagaaacaaaauauuaagaacacaagagucugaauguguuuguauaaacgguucguguuuuacuauaaugacugacggcccaagcaaugggcaagccucguacaaauuauucaaaauggagaaagggaagauuauuaagucaauugagcuggaugcaccuaauuaccacuaugaggaaugcuccuguuacccugauacaggcaaaguggugugugugugcagagacaauuggcaugcuucgaaucgaccaugggucucuuucgaucagaaucuugauuaucaaauaggguacauaugcagugggguuuucggugauaauccgcguucuaaugaugggaaaggcaauuguggcccaguacuuucuaauggagcaaauggagugaagggguuuucauuuagauauggcaaugguguuuggauaggaagaacuaaaaguaucagcucuagacguggauuugagaugauuugggauccuaauggauggacagaaacugauaguaguuucucuaugaagcaagauauuauagcauuaacugauuggucgggauacaguggaaguuuuguccaacauccugaauuaacaggaaugaacugcauaaggccuuguuucuggguagaguuaaucagagggcaacccaaggagagcacaaucuggacuaguggaagcagcauuucuuucuguggcgugaacaguggcacugcaagcuggucauggccagacggagcugaucugccauucaccauugacaaguag

SEQ ID NO: 56517 - RNA, 1413 nt, Artificial Sequence
  neuraminidase__InfluenzaA__BAA06717
augaauccaaaucagaaaauaauaaccauuggaucaaucaguauggcaaucggaauaauuagucuaauauugcaaauagggaauauuauuucaauaugggcgagccacucaauccaaacuggaagucaaaaccacacuggaauaugcaaccaaagaaugauuacauaugaaaauagcaccugggugaaucaaacauauguuaauauuagcaacacuaauguuguugcuggaaaggacaaaacuucagugacauuagccggcaauucaucucuuugcccuauccgugggugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagguuacuaaaucaauagaguuggaugcacccaauuaucauuacgaggaauguuccuguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccaguaacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucagugaaacaggaugucguggcaaugacugauuggucaggguacagcggaaguuucguucaacauccugagcuaacaggauuggacuguaugagaccuugcuucuggguugaauuaaucagagggcgaccuagagaaaagacaacaaucuggacuagugggagcagcauuucuuuuuguggcguaaauagcgauacugcaaacuggucuuggccagacggugccgaguugccauucaccauugacaaguag

SEQ ID NO: 56518 - RNA, 1413 nt, Artificial Sequence
  neuraminidase__InfluenzaA__BAA06718
augaauccaaaucagaaaauaauaaccauaggaucaaucuguauggcaauaggaauaauuagucuaauauugcaaauaggaaauauuguuucaauauggauuagccacucaauccaaacuggaagucaaaacuacacuggaauaugcaaccaaagaaucauuaccuaugaaaauagcaccuggguaaaucaaacauauguuaauauuaacaacacuaauguuguugcuggacaggacacaacuucaguggcauuagccggcaauucaucucuuuguccuaucagugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaauggaaccguuaaggacagaagcccuuauaggcgcuuaaugagcuguccuauaggugaagcuccgucucccuacaauucaagguuugaaucgguugcuuggucagcaagcgcaugucaugauggcaugggcuggcuaacaaucggaauuucugguccagaugauggagcaguggcuguacuaaaauacaacgguauaauaacugaaaccauaaaaaguuggaggaagcgaauauuaagaacacaagagucugaaugugucuguguaaacgguucauguuuuaccauaaugaccgauggcccgaauaaugggccggccucguacagaaucuucaaaaucgagaaggggaagauuacuaaaucaauagaguuggaugcacccaauucucauuacgaggaauguuccuguuacccagacgccggcacagugaugugugugugcagagacaauuggcaugguucgaaucgaccuugggugucuuuuaaucaaaaccuggauuaucaaauaggauacaucugcagugguguuuuuggugacaauccgcgucccaaagauggaaaaggcagcugugauccaguaacuguugauggagcagacggaguaaagggguuuucauacagguaugguaaugguguuuggauaggaaggacuaaaaguaacagcuccagaagaggauuugagaugauuugggauccuaauggauggacagauaccgauaguaaauucuuagugaaacaggauguaguggcaaugacugauuggucaggguacagcggaagcuucguucaacauccugaacuaacaggauuggauuguaugaggccuugcuucuggguugaauuagucagaggacgaccuagagaaaauacaacaaucuggacuagugggagcagcauuucuuuuuguggcgugaauggugauacugcaaauuggucuuggccagacggugccgaguugccauucaccauugacaaguag

SEQ ID NO: 56519 - RNA, 1413 nt, Artificial Sequence
  neuraminidase__InfluenzaA__BAA06720
augaauccaaaucagaaaauaauaaccauuggaucaaucaguauggcaaucggaauaauuagucuaauauugcaaauaggaaauauuauuucaauauggguuagccacucaauccaaacuggaagucaaaaccacacuggaauaugcaaccaaagaaucauuacauaugaaaauagcaccugggugaaucaaacauauguuaauauuaacaacacuaauguuguugcuggaaaggacaaaacuucagugacauuggccggcaauucaucucuuugcccuauccuugggugggcuauauacacaaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauaggcgcuuaaugagcuguccucuaggugaagcuccgucuccauacaauucaagguuugaaucaguugcuuggucagcaagcgcaugccaugauggcaugggcuggcuaacaaucggaauuucugguccagaugauggagcaguggcuguacuaaaauacaacggcauaauaacugaaaccauaaaaaguuggaagaagcgaauauuaagaacacaagagucugaaugugucuguguaaacgguucauguuuuaccauaaugaccgauggcccgaguaauggggccgccucguacagaaucuucaaaaucgagaaggggaagguuacuaaaucaauagaguuggaugcacccaauucucauuacgaggaauguuccuguuacccagacaccggcacagugaugugugugugcagggacaauuggcacgguucaaaucgaccuugggugucuuuuaaucaaaaccuggauuaucaaauaggauacaucugcagugggguguucggugacaauccgccucccaaagauggaaaaggcagcuguaauccagugacuguugauggagcagacggaguaaagggguuuucauacagauaugguaaugguguuuggauaggaaggacuaaaaguaacagauucagaaagggauuugagaugauuugggauccuaauggauggacagauaccgacagugauuucucagugaaacaggauguaguggcaaugacugauuggucaggguacagcggaaguuucguucaacauccugagcuaacaggauuggacuguaugagaccuugcuucuggguugaauuagucagagggcggccuagagaaaauacaacaaucuggacuagugggagcagcauuucuuuuuguggcgugaauagugauacugcaaacuggucuuggccagacggugccgaguugccauucaccauugacaaguag

SEQ ID NO: 56520 - RNA, 1410 nt, Artificial Sequence
  neuraminidase__InfluenzaA__BAD16637
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauucacgcucagguuaugagacuuucaaagucauuggugguugguccacaccuaauuccaaaucgcaggucaauagacaggucauaguuggcaacaauaauuggucugguuacucugguauuuucucuguugagggcaaaagcugcaucaauaggugcuuuuauguggaguugauaaggggaaugccacaggagacuagaguaugguggaccucaaacaguauuguuguguuuuguggcacuucagguacuuauggaacaggcucauggccugauggggcgaacaucaauuucaugccuauauaa

SEQ ID NO: 56521 - RNA, 1410 nt, Artificial Sequence
  neuraminidase__InfluenzaA__BAD16638
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaugagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 56522 - RNA, 1410 nt, Artificial Sequence
  neuraminidase__InfluenzaA__BAD16639
augaauccaaaucagaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaagcccucaucgaacccuauuaaugaaugaguuggguguuccauuucauuuaggaaccaaacaagugugugcagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuggcccauugucaggaagugcucagcauauagaggaguguucuuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaggauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguauuuuguggcacuucagguacuuauggaacaggcucauggccugauggggcgaacaucaauuucaugccuauauaa

SEQ ID NO: 56523 - RNA, 1410 nt, Artificial Sequence
  neuraminidase__InfluenzaA__BAD16640
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagaucugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaaugcaacugcuagcuucauuuaugacgggaggcuuauggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucauagacauaaauauggaagauuauagcauugauuccaguuaugugugcucagggcuuguuggcgacacacccagaaacgacgacagaucuagcaauaguaauugcaggaauccuaacaaugagagagggaauccaggagugaaaggcugggccuuugacaauggagaugacguguggaugggaagaacgaucagcaaggauuuacgcucagguuaugagacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 56524 - RNA, 1410 nt, Artificial Sequence
  neuraminidase__InfluenzaA__BAD16641
augaauccaaaucaaaagauaauaacaauuggcucugccucucucaccauugcaacaguaugcuuccucaugcagauugccauccugguaacuacuguaacauugcauuucaagcaacaugagugcgacucccccgcgagcaaccaaguaaugccgugugaaccaauaauaauagaaaggaacacaacagagauaguguauuugaauaacaccaccauagagaaagagauaugccccaaaguaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuuguacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucguagacauaaauauggaagauuauagcauugauuccaguuaugugugcucagggcuuguuggagacacaccuagaaacgacgacagaucuagcaauagcaauugcagaaauccuaacaaugagaaagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauaggcaagucauaguugacagcgauaauaggucagguuauucugguauuuucucuguugagggcaaaagcugcaucaauaggugcuuuuauguggaguugauaaggggaaggaaacaggagacuagaguaugguggaccucaaacaguauugucguguucuguggcacuucagguaccuaugggacaggcucauggccugauggggcgaacaucaaucucaugccuauauaa

SEQ ID NO: 56525 - RNA, 1410 nt, Artificial Sequence
  neuraminidase__InfluenzaA__BAD16642
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagacaaagagaaaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaauaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 56526 - RNA, 1410 nt, Artificial Sequence
  neuraminidase__InfluenzaA__BAD16643
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguuuguucacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 56527 - RNA, 1410 nt, Artificial Sequence
  neuraminidase__InfluenzaA__BAD16644
augaauccaaaucaaaagauaauaacaauugggucugucucucucaccauugcaacaauaugcuuccucaugcagauugccauccugguaacuacuguaacauugcauuucaagcaauaugaaugcgacucccccccgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcauggucucgcucaaguugucacgauggaaaagcauggcugcauguuugugucacuggguaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguugugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 56528 - RNA, 1410 nt, Artificial Sequence
  neuraminidase__InfluenzaA__BAD16645
augaauccaaaucaaaagauaauaacaauuggcucugucucucucaccauugcaacaauaugcuuccuuaugcaaauugccauccugguaacuacuguaacauugcauuucaagcaauaugagugcgacuccccagcgaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaauguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauacuagcccauugucaggaagugcucagcauguagaggaguguuccuguuauccucgauauccuggugucagauguaucugcagagacaacuggaaaggcucuaauaggccagucguagauauaaaugugaaagauuauagcauugauuccaguuaugugugcucagggcuugugggcgacacacccagaaacaacgacagaucuagcaguagcuauugccggaauccuaacaaugaaaaagggacucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 56529 - RNA, 1410 nt, Artificial Sequence; identical to SEQ ID NO: 53048
  neuraminidase__InfluenzaA__BAD16646

SEQ ID NO: 56530 - RNA, 1410 nt, Artificial Sequence
  neuraminidase__InfluenzaA__BAD16647
augaauccaaaucaaaagauaauaacaauuggcucugucucucucaccauugcaacaauaugcuuccucaugcagauugccauccugguaacuacuguaacauugcauuucaagcaauaugagugcgacuccccagcgaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaauguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauacuagcccauugucaggaagugcucagcauguagaggaguguuccuguuauccucgauauccuggugucagauguaucugcagagacaacuggaaaggcucuaauaggccagucguagauauaaaugugaaagauuauagcauugauuccaguuaugugugcucagggcuugugggcgacacacccagaaacaacgacagaucuagcaguagcuauugccggaauccuaacaaugaaaaagggacucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 56531 - RNA, 1410 nt, Artificial Sequence
  neuraminidase__InfluenzaA__BAD16648
augaauccaaaucaaaagauaauaacaauugguucugucucucucaccauugcaacaauaugcuuccuuaugcaaaucgccauucugguaacuacugugacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauaggaccccuuaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauagguucaugguccaaaaauauccucaggacccaggagucggaauguguuuguaucuaugggacuuguacaguaguaaugacugauggaagugcuucagaaagagcugaaacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaggucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 56532 - RNA, 1410 nt, Artificial Sequence
  neuraminidase__InfluenzaA__BAE07203
augaauccaaaucagaagauaacaaccauuggaucaaucuguaugguaauuggaauaguuagcuugauguuacaaauugggaacauaaucucaauauggguuagucauucaauucaaacagggaaucaacaccaggcugaaccaugcaaucaaagcauuauuacuuaugaaaacaacaccuggguaaaccagacauaugucaacaucagcaauaccaauuuucuuacugagaaagcuguggcuucaguaacauuagcgggcaauucaucucuuugccccauuaguggaugggcuguauacaguaaggacaacgguauaagaaucgguuccaagggggauguguuuguuauaagagagccguucaucucaugcucccacuuggaaugcagaacuuucuuuuugacucagggagccuugcugaaugacaagcauucuaaugggaccgucaaagacagaagcccucacagaacauuaaugaguugucccgugggugaggcuccuuccccauacaacucgagguuugagucuguugcuuggucggcaagugcuugucaugauggcacuaguugguugacaauuggaauuucuggcccagacaauggggcuguggcuguauugaaauacaauggcauaauaacagacacuaucaagaguuggaggaacaacauaaugagaacucaagagucugaaugugcauguguaaauggcucuugcuuuacuguuaugacugauggaccaaguaaugggcaggcuucauacaaaaucuucagaauagaaaaagggaaaguaguuaaaucagccgaauuaaaugccccuaauuaucacuaugaggagugcuccuguuauccugaugcuggagaaaucacaugugugugcagggauaacuggcauggcucaaaucggccauggguaucuuucaaucaaaauuuggaguaucgaauaggauauauaugcaguggaguuuucggagacaauccacgccccaaugaugggacaggcaguugugguccgguguccccuaaaggggcauauggaauaaaaggguucucauuuaaauacggcaaugguguuuggaucgggagaaccaaaagcacuaauuccaggagcggcuuugaaaugauuugggauccaaauggauggacugguacggacaguaauuuuucaguaaagcaagauauuguagcuauaaccgauuggucaggauauagcgggaguuuuguccagcauccagaacugacaggauuagauugcauaagaccuuguuucuggguugagcuaaucagagggcggcccaaagagagcacaauuuggacuagugggagcagcauauccuuuugugguguaaauagugacacuguggguuggucuuggccagacggugcugaguugccauucaccauugacaaguag

SEQ ID NO: 56533 - RNA, 1410 nt, Artificial Sequence
  neuraminidase__InfluenzaA__BAF46322
augaauccaaauccaaagauaauaacgauuggcucuguuucucucaccauuuccacaauaugcuucuucaugcaaauugccaucuugauaacuacuguaacauugcauuuuaagcaauaugaauucaacuccccuccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacacagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56534 - RNA, 1410 nt, Artificial Sequence
  neuraminidase__InfluenzaA__BAF46323
augaauccaaaucaaaagauaauaacgauuggcucuguuucucucaccauuuccacaauaugcuucuucaugcaaauugccaucuugauaacuacuguaacauugcauuuuaagcaauaugaauucaacuccccuccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacacagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56535 - RNA, 1410 nt, Artificial Sequence
  neuraminidase__InfluenzaA__BAF46324
augaauccaaaucaaaagauaauaacgauuggcucuguuucucucaccauuuccacaauaugcuucuucaugcaaauugccauuuugauaacuacuguaacauugcauuuuaagcaauaugaauucaacuccccuccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacauagugcaugauaggaccccuuaucggacccuauugaugaaugaguuagguguuccauuucaucuggggaccaagcaagugugcauagcaugguccagcucaaguugucacgauggaaaagcauggcugcauguuuggguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56536 - RNA, 1410 nt, Artificial Sequence
  neuraminidase__InfluenzaA__BAF46332
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaccaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56537 - RNA, 1410 nt, Artificial Sequence
  neuraminidase__InfluenzaA__BAF46334
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56538 - RNA, 1410 nt, Artificial Sequence; identical to SEQ ID NO: 56537
  neuraminidase__InfluenzaA__BAF46335

SEQ ID NO: 56539 - RNA, 1410 nt, Artificial Sequence
  neuraminidase__InfluenzaA__BAF46337
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaguacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguguuaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguagaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggauggcaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56540 - RNA, 1410 nt, Artificial Sequence; identical to SEQ ID NO: 56537
  neuraminidase__InfluenzaA__BAF46345

SEQ ID NO: 56541 - RNA, 1410 nt, Artificial Sequence
  neuraminidase__InfluenzaA__BAF46346
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaacauugcaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucauaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56542 - RNA, 1410 nt, Artificial Sequence
  neuraminidase__InfluenzaA__BAF46347
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuaccuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56543 - RNA, 1410 nt, Artificial Sequence
  neuraminidase__InfluenzaA__BAF46349
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauauagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugcuaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucuuugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56544 - RNA, 1410 nt, Artificial Sequence; identical to SEQ ID NO: 56537
  neuraminidase__InfluenzaA__BAF46350

SEQ ID NO: 56545 - RNA, 1410 nt, Artificial Sequence
  neuraminidase__InfluenzaA__BAF46351
augaauccaauucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaugguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56546 - RNA, 1410 nt, Artificial Sequence
  neuraminidase__InfluenzaA__BAF46368
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugaaaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56547 - RNA, 1410 nt, Artificial Sequence
  neuraminidase__InfluenzaA__BAF46369
augaauccaaaucaaaagauaauaacgauuggcucuguuucucucaccauuuccacaauaugcuucuucaugcaaauugccaucuugauaacuacugugacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcgccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaagaaugcaacugcuagcuucauuuacaaugggaagcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaaggugggcauggagugaaaggcugggccuuugaugauggaaaugacguguggaugggaagaacgaucagcgagaagucacgcucaggauaugaaaccuuccaagucauugaaggcugguccaacucuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56548 - RNA, 1410 nt, Artificial Sequence
  neuraminidase__InfluenzaA__BAF46370
augaauccaaaucaaaagauaauaacgauuggcucuguuucucucaccauuuccacaauaugcuucuucaugcaaauugccaucuugauaacuacuguaacauugcauuucaagcaauaugaauucaacucccucccaaacaaccaagugaugcugugugaaccaacaauaauagaaaggaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaaguaugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggggugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaccaguauuguuguguuuuguggcuccucagguacauauggaacaggcucauggccugauggggcggacaucaaucucaugccuauauaa

SEQ ID NO: 56549 - RNA, 1410 nt, Artificial Sequence
  neuraminidase__InfluenzaA__BAF46371
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauagugcaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuugugugacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacaccccgaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagaaguaauagguccgguuauucugguauuuucucuguugaaggcaaaagcugcaucaaucggugcuuuuauguggaguugauaaggggaagaaaagaggaaacugaagucuuguggaccucaaacagcauuguuguguuuuguggcaccucagguacauauggaacaggcucauggccugauggggcggacaucaaucucaugccuauauaa

SEQ ID NO: 56550 - RNA, 1410 nt, Artificial Sequence
  neuraminidase__InfluenzaA__BAF46372
augaauccaaaucaaaagauaauaacgauuggcucuguuucucucaccauuuccacaauaugcuucuucaugcaaauugccaucuugauaacuacuguaacauugcauuuuaagcaauaugaauucaacuccccuccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauugcaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacacagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56551 - RNA, 1410 nt, Artificial Sequence
  neuraminidase__InfluenzaA__BAF46385
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugauguugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugucucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucccgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugccagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucaaguacauauggaacaggcucauggccugauggggcggauaucaaucucaugccuauauaa

SEQ ID NO: 56552 - RNA, 1410 nt, Artificial Sequence
  neuraminidase__InfluenzaA__BAF46386
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucaaguacauauggaacaggcucauggccugauggggcggacaucaaucucaugccuauauaa

SEQ ID NO: 56553 - RNA, 1410 nt, Artificial Sequence
  neuraminidase__InfluenzaA__BAF46387
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56554 - RNA, 1410 nt, Artificial Sequence
  neuraminidase__InfluenzaA__BAF46388
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuaggaguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugccgagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagacauaguugacagagguaauagguccgguuauucugguauuuucucuguugaaggcaaaaguugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaucucaugccuauauaa

SEQ ID NO: 56555 - RNA, 1410 nt, Artificial Sequence
  neuraminidase__InfluenzaA__BAF47922
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacauccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggacgauaaaaaugcaacugcuagcuucauuuacaaugggaggcuuguagauaguauuguuucaugguccaaagaaauccucaggacccaggagucagaaugcguuuguaucaauggaacuuguacaguaguaaugaccgaugggagugcuucaggaaaagcugauacuaaaauacuguucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauugcuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56556 - RNA, 1410 nt, Artificial Sequence
  neuraminidase__InfluenzaA__BAF47923
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgauaagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56557 - RNA, 1410 nt, Artificial Sequence
  neuraminidase__InfluenzaA__BAF47924
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacagugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56558 - RNA, 1410 nt, Artificial Sequence
  neuraminidase__InfluenzaA__BAF47925
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuggcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucaggugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56559 - RNA, 1410 nt, Artificial Sequence
  neuraminidase__InfluenzaA__BAF47926
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagagagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaauuacgcucaggauaugaaaccuucaaagucauugaaggcugguccaacccuaauuccaaauugcagauaaauaggcaagucauaguugacagagguaauagguccgguuauucugguauuuuuucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 56560 - RNA, 1410 nt, Artificial Sequence
  neuraminidase__InfluenzaA__BAF47927
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaccucaugccuauauaa

SEQ ID NO: 56561 - RNA, 1410 nt, Artificial Sequence; identical to SEQ ID NO: 51206
  neuraminidase__InfluenzaA__BAF47928

SEQ ID NO: 56562 - RNA, 1410 nt, Artificial Sequence
  neuraminidase__InfluenzaA__BAF47929
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccacagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucagaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgauaagcgagaaguuacgcucaggauaugaaaccuucaaagucauugaaggcugguccaacccuaauuccaaauugcagauaaauaggcaagucauaguugacagagguaauagguccgguuauucugguauuuucucuguugaagguaaaagcugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaucucaugccuauauaa

SEQ ID NO: 56563 - RNA, 1410 nt, Artificial Sequence
  neuraminidase__InfluenzaA__BAF47930
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugguaggaccccuuaucggacccuauugaugaaugaguuagguguuccauuucaucugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcacuguuucuaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56564 - RNA, 1410 nt, Artificial Sequence
  neuraminidase__InfluenzaA__BAF47931
augaauccaaaucaaaagauaauaacgauuggcucuguuucucucaccauuucuacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaaguugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaucucaugccuauauaa

SEQ ID NO: 56565 - RNA, 1410 nt, Artificial Sequence
  neuraminidase__InfluenzaA__BAF47932
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56566 - RNA, 1410 nt, Artificial Sequence
  neuraminidase__InfluenzaA__BAF47933
augaauccaaaucaaaagauaauaacgauuggcucuguuucucucaccauuuccacaauaugcuucuucaugcaaauugcuaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56567 - RNA, 1410 nt, Artificial Sequence; identical to SEQ ID NO: 56534
  neuraminidase__InfluenzaA__BAF47934

SEQ ID NO: 56568 - RNA, 1410 nt, Artificial Sequence
  neuraminidase__InfluenzaA__BAF47935
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacacagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaacuuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56569 - RNA, 1410 nt, Artificial Sequence
  neuraminidase__InfluenzaA__BAF47936
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguuaauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56570 - RNA, 1410 nt, Artificial Sequence
  neuraminidase__InfluenzaA__BAF47937
augaauccaaaucaaaagauaauaacgauuggcucuguuucucucaccauuuccacaauaugcuucuucaugcaaauugcuaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgguccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56571 - RNA, 1410 nt, Artificial Sequence
  neuraminidase__InfluenzaA__BAF47938
augaauccaaaucaaaagauaauaacgauuggcucuguuucucucaccauuuccacaauaugcuucuucaugcaaauugccaucuugauaacuacuguaacauugcauuucaagcaauaugaauucaacucccucccaaacaaccaagugaugcugugugaaccaacaauaauagaaaggaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugguaggaccccuuaucggacccuauugaugaaugaguuagguguuccauuucaucuggggaccaagcaaguaugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaccgacagcuccagcaguagccauugcuuggauccuaacaaugaagaagguggucauggggugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56572 - RNA, 1410 nt, Artificial Sequence
  neuraminidase__InfluenzaA__BAF47939
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacacagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56573 - RNA, 1410 nt, Artificial Sequence
  neuraminidase__InfluenzaA__BAF47940
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuauguaucaugcgauccugacaaguguuaucaauuugcucuuggacagggaacaacacuaaacaacgugcauucaaaugacacagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaacuuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagagaaaacugaagucuuguggaccucaaacaguauuguuguguuuuguggcaccucagguacauauggaacaggcucauggccugauggggcggacaucaaucucaugccuauauaa

SEQ ID NO: 56574 - RNA, 1410 nt, Artificial Sequence; identical to SEQ ID NO: 56558
  neuraminidase__InfluenzaA__BAF47941

SEQ ID NO: 56575 - RNA, 1410 nt, Artificial Sequence
  neuraminidase__InfluenzaA__BAF47943
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugauugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56576 - RNA, 1410 nt, Artificial Sequence
  neuraminidase__InfluenzaA__BAF47944
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugauguugugugaaccaacaauaauagaaagaaacauaacagagauaguguaucugaccaacaccaccauagagaaggaaauaugccccaaacuaacagaauacagaaauuggucaaagccgcaauguaacauuacaggauuugcaccuuuuucuaaggacaauucgauuaggcuuuccgcugguggggacaucugggugacaagagaaccuuaugucucaugcgauccugacaaguguuaucaauuugcccuuggacagggaacaacacuaaacaacgugcauucaaaugacccaguacaugauaggaccccuuaucggacccuauugaugaaugaguuagguguuccauuccaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaaugacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56577 - RNA, 1410 nt, Artificial Sequence
  neuraminidase__InfluenzaA__BAF47945
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaagcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56578 - RNA, 1410 nt, Artificial Sequence
  neuraminidase__InfluenzaA__BAF47946
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaaguccuugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56579 - RNA, 1410 nt, Artificial Sequence
  neuraminidase__InfluenzaA__BAF47948
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacaaagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacucuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56580 - RNA, 1410 nt, Artificial Sequence
  neuraminidase__InfluenzaA__BAF47949
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacaaagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56581 - RNA, 1410 nt, Artificial Sequence; identical to SEQ ID NO: 56572
  neuraminidase__InfluenzaA__BAF47950

SEQ ID NO: 56582 - RNA, 1410 nt, Artificial Sequence
  neuraminidase__InfluenzaA__BAF47951
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacacagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacucuaauuccaaauugcagauaaauaggcaaguaauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56583 - RNA, 1410 nt, Artificial Sequence
  neuraminidase__InfluenzaA__BAF47952
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 56584 - RNA, 1410 nt, Artificial Sequence
  neuraminidase__InfluenzaA__BAF47953
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacacagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56585 - RNA, 1410 nt, Artificial Sequence
  neuraminidase__InfluenzaA__BAF47954
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguaucguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56586 - RNA, 1410 nt, Artificial Sequence; identical to SEQ ID NO: 56585
  neuraminidase__InfluenzaA__BAF47955

SEQ ID NO: 56587 - RNA, 1410 nt, Artificial Sequence
  neuraminidase__InfluenzaA__BAF47956
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaagauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaauuucaugccuauauaa

SEQ ID NO: 56588 - RNA, 1410 nt, Artificial Sequence
  neuraminidase__InfluenzaA__BAF47958
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuaaugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaagauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacaaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggacugauggggcggacaucaauuucaugccuauauaa

SEQ ID NO: 56589 - RNA, 1410 nt, Artificial Sequence
  neuraminidase__InfluenzaA__BAF47959
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccacuauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauuacacaguacaugauaggaccccuuaucggacccuauugaugaaugaguuagguguuccauuucaucuggggaccaagcaagugugcauagcaugguccagcucaaguugucacgauggaaaagcauggcugcauguuugugugacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56590 - RNA, 1410 nt, Artificial Sequence
  neuraminidase__InfluenzaA__BAF47960
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacauaauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggaugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56591 - RNA, 1410 nt, Artificial Sequence
  neuraminidase__InfluenzaA__BAF47975
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucacaugccuauauaa

SEQ ID NO: 56592 - RNA, 1410 nt, Artificial Sequence; identical to SEQ ID NO: 56566
  neuraminidase__InfluenzaA__BAF47976

SEQ ID NO: 56593 - RNA, 1410 nt, Artificial Sequence
  neuraminidase__InfluenzaA__BAF47977
augaauccaaaucaaaagauaauaacgauuggcucuguuucucucaccauuuccacaauaugcuucuucaugcaaauugccaucuugauaacuacuguaacauugcaauucaagcaauaugaauucaacucccccccaaacaaccaagugauguugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugucucaugcgauccugacaaguguuaucaauuugcccuuggacagggaacaacacuaaacaacgugcauucaaaugacacaguacaugguaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56594 - RNA, 1410 nt, Artificial Sequence
  neuraminidase__InfluenzaA__BAF47978
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuauaaugggaggcuuguagauaguauuguuucaugguccaaagaaauccucaggacccaggagucagaaugcguuuguaucaauggaacuuguacaguaguaaugacugaugggagugcuuccggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggaucccaacaaugaagaagguggucauggagugaaaggcugggccuuugaugauggaaaugacgcguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56595 - RNA, 1410 nt, Artificial Sequence
  neuraminidase__InfluenzaA__BAF47979
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugauguugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugucucaugcgauccugacaaguguuaucaauuugcccuuggacagggaacaacacuaaacaacgugcauucaaaugacacaguacauaauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaauaggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56596 - RNA, 1410 nt, Artificial Sequence
  neuraminidase__InfluenzaA__BAF47980
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugauguugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugucucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56597 - RNA, 1410 nt, Artificial Sequence
  neuraminidase__InfluenzaA__BAF47981
augaauccaaaucaaaagauaauaacgauuggcucuguuucucucaccauuuccacaauaugcuuauucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56598 - RNA, 1410 nt, Artificial Sequence
  neuraminidase__InfluenzaA__BAF47982
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56599 - RNA, 1410 nt, Artificial Sequence; identical to SEQ ID NO: 56596
  neuraminidase__InfluenzaA__BAF47983

SEQ ID NO: 56600 - RNA, 1410 nt, Artificial Sequence
  neuraminidase__InfluenzaA__BAF47984
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugguagaaccccuuaucggacccuauugaugaaugaguuagguguuccauuucaucuggggaccaagcaagugugcauagcaugguccagcucaaguugucacgauggaaaagcauggcugcauguuuguguaacgggagaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaaggugaucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56601 - RNA, 1410 nt, Artificial Sequence
  neuraminidase__InfluenzaA__BAF47985
augaauccaaaucaaaagauaauaacgauuggcucuguuucucucaccauuuccacaauaugcuucuucaugcaaauugcaaucuugauaacuacuguaacauugcauuuuaagcaauaugaauucaacuuccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacacagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56602 - RNA, 1410 nt, Artificial Sequence
  neuraminidase__InfluenzaA__BAF47986
augaauccaaaucaaaagauaauaacgauuggcucuguuucucucaccauuuccacaauaugcuucuucaugcaaauugcaaucuugauaacuacuguaacauugcauuuuaagcaauaugaauucaacuuccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacacagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggcgcuuuuauguggaguugauaaggggaagaaaagaagaaacugaagucuuguggaccucaaacaguauuguuguguuuuguggcaccucagguacauauggaacaggcucauggccugauggggcggacaucaaucucaugccuauauaa

SEQ ID NO: 56603 - RNA, 1410 nt, Artificial Sequence
  neuraminidase__InfluenzaA__BAF47987
augaauccaaaucaaaagauaauaacgauuggcucuguuucucucaccauuucgacaauaugcuucuucaugcaaauugcaaucuugauaacuacuguaacauugcauuuuaagcaauaugaauucaacuuccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacaaagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56604 - RNA, 1410 nt, Artificial Sequence; identical to SEQ ID NO: 56568
  neuraminidase__InfluenzaA__BAF47988

SEQ ID NO: 56605 - RNA, 1410 nt, Artificial Sequence
  neuraminidase__InfluenzaA__BAF47989
augaauccaaaucaaaagauaauaacgauuggcucuguuucucucaccauuuccacaauaugcuucuucaugcaaauugccaucuugauaacuacuguaacauugcauuuuaagcaauaugaauucaacuccccuccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugugauccugacaaguguuaucaauuugcucuuggacagggaacaacacuaaacaacgugcauucaaaugacacagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugauguguggaugggaagaacgaucagugagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56606 - RNA, 1410 nt, Artificial Sequence
  neuraminidase__InfluenzaA__BAF47990
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaguacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaauaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacggucagcgaaaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaauugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 56607 - RNA, 1410 nt, Artificial Sequence
  neuraminidase__InfluenzaA__BAF47991
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacauagugcaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccugguaucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56608 - RNA, 1410 nt, Artificial Sequence
  neuraminidase__InfluenzaA__BAF47992
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgagccugacaaguguuauccauuugcccuuguacagggaacaacucuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguuuuguuguguuuuguggcaccucagguacauauggaacaggcucauggccugauggggcggacaucaaucucaugccuauauaa

SEQ ID NO: 56609 - RNA, 1410 nt, Artificial Sequence
  neuraminidase__InfluenzaA__BAF47993
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56610 - RNA, 1410 nt, Artificial Sequence
  neuraminidase__InfluenzaA__BAF47994
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaguacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgaaaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaauugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 56611 - RNA, 1410 nt, Artificial Sequence
  neuraminidase__InfluenzaA__BAF47995
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaguacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugguaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgaaaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaauugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 56612 - RNA, 1410 nt, Artificial Sequence; identical to SEQ ID NO: 56611
  neuraminidase__InfluenzaA__BAF47996

SEQ ID NO: 56613 - RNA, 1410 nt, Artificial Sequence; identical to SEQ ID NO: 56572
  neuraminidase__InfluenzaA__BAF47997

SEQ ID NO: 56614 - RNA, 1410 nt, Artificial Sequence
  neuraminidase__InfluenzaA__BAF57504
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagaaauaguguaucugaccaacaccaccauagagaaggaaauaugccccaaacuagcagaauacagaaauuggucaaagccgcaauguaacauuacaggauuugcaccuuuuucuaaagacaauucgauucggcuuuccgcugguggggacaucugggugacaagagaaccuuaugugucuagcgauccugacaaguguuaucaauuugcccuuggacagggaacaacacuaaacaacgugcauucaaaugacacaguacaugauaggaccccuuaucggacccuauugaugaaagaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguguuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcuccuggccugauggggcggacaucaaucucaugccuauauaa

SEQ ID NO: 56615 - RNA, 1410 nt, Artificial Sequence
  neuraminidase__InfluenzaA__BAF57508
augaauccaaaucaaaagauaauaacgauuggcucuguuucucucaccauuuccacaauaugcuucuucaugcaaauugccauccugauaacuacuuuaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaauguguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaauuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 56616 - RNA, 1410 nt, Artificial Sequence
  neuraminidase__InfluenzaA__BAF57511
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaauguguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaauuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 56617 - RNA, 1410 nt, Artificial Sequence
  neuraminidase__InfluenzaA__BAF57515
augaauccaaaucaaaggauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacaaaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaauguguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccuguuauccucgauauccuggugucagaugugucugcagagacaacuggaaaggcuccaauaggcccaucguagauauaaacauaaaggauuauagcauuguuuccaguuaucugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaauuacgcucaggauaugaaaccuucaaagucauugaaggcuggucccacccuaacucccaauugcagauaaauaggcaagucauaguugacagagguaauagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 56618 - RNA, 1410 nt, Artificial Sequence
  neuraminidase__InfluenzaA__BAF57522
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaucauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggagacuuguagauaguauuguuucaugguccaaaaaaauccucaggacccaggagucagaaugcguuuguaucaauggaacguguacaguaguaaugacugaugggagugcuucaggaaaagcugauacuaaaauacuauucauugaggaggggaaaaucguucauacuagcacauugucaggaagugcucagcaugucgaggagugcuccuguuauccucgauaucccggugucagaugugucugcagagacaacuggaaaggcuccaauaggcccaucguagauauaaacauaaaggauuauagcauuguuuccaguuaugugugcucaggacuuguuggagacacacccagaaaaaacgaccgcucccgcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugagggcugguccaaaccuaacuccaaauugcagauaaauaggcaagucauaguugacagagguaauaggaccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 56619 - RNA, 1410 nt, Artificial Sequence
  neuraminidase__InfluenzaA__BAF57529
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacaaaguacaugagaggaccccuuaucggaccuuauugaugaaugaauuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauagcauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaaugacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56620 - RNA, 1410 nt, Artificial Sequence
  neuraminidase__InfluenzaA__BAF57532
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacauaauaggaccccuuaucggaccuuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaaugacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56621 - RNA, 1410 nt, Artificial Sequence; identical to SEQ ID NO: 52055
  neuraminidase__InfluenzaA__BAF57536

SEQ ID NO: 56622 - RNA, 1410 nt, Artificial Sequence
  neuraminidase__InfluenzaA__BAF57539
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggaccuuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuauagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccaggaaaaacgacagcuccagcaguagccauugcuuggauccuaacaaugaagaagguggucauggagugaaaggcugggccuuugaugauggaaaugacguguggaugggaagaacgaucagcgagaaguugcgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagagaaaacugaagucuuguggaccucaaacaguauuguuguguuuuguggcaccucagguacauauggaacaggcucauggccugauggggcggacaucaaucucaugccuauauaa

SEQ ID NO: 56623 - RNA, 1410 nt, Artificial Sequence
  neuraminidase__InfluenzaA__BAF57543
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggaccuuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugcuauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56624 - RNA, 1410 nt, Artificial Sequence
  neuraminidase__InfluenzaA__BAF57547
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggaccuuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagccuuguggaccucaaacaguauuguuguguuuuguggcaccucagguacauauggaacaggcucauggccugauggggcggacaucaaucucaugccuauauaa

SEQ ID NO: 56625 - RNA, 1410 nt, Artificial Sequence; identical to SEQ ID NO: 52062
  neuraminidase__InfluenzaA__BAF57551

SEQ ID NO: 56626 - RNA, 1410 nt, Artificial Sequence; identical to SEQ ID NO: 51953
  neuraminidase__InfluenzaA__BAF57555

SEQ ID NO: 56627 - RNA, 1410 nt, Artificial Sequence; identical to SEQ ID NO: 45232
  neuraminidase__InfluenzaA__BAF57559

SEQ ID NO: 56628 - RNA, 1410 nt, Artificial Sequence
  neuraminidase__InfluenzaA__BAF57563
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacauaguacaugauaggaccccguaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaggaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucuguagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucgguguuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56629 - RNA, 1410 nt, Artificial Sequence
  neuraminidase__InfluenzaA__BAF57571
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucguggccugauggggcggacaucaaucucaugccuauauaa

SEQ ID NO: 56630 - RNA, 1410 nt, Artificial Sequence; identical to SEQ ID NO: 51960
  neuraminidase__InfluenzaA__BAF57575

SEQ ID NO: 56631 - RNA, 1410 nt, Artificial Sequence
  neuraminidase__InfluenzaA__BAF57579
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccguaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaggaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucuguagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgaaaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucgguguuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56632 - RNA, 1410 nt, Artificial Sequence
  neuraminidase__InfluenzaA__BAF57583
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucagggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56633 - RNA, 1410 nt, Artificial Sequence
  neuraminidase__InfluenzaA__BAF57587
augaauccaaaucaaaagauaauaacgauuggcucuguuucucucaccauuuccacaauaugcuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaauaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56634 - RNA, 1410 nt, Artificial Sequence
  neuraminidase__InfluenzaA__BAF57591
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaaugcuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacaggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucagggaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguacauauaaacauaaaggauuauagcauuguuuccaguuaugugugcucaggacuuguuggagacacacccagaaaaaacgacagcuccagcaguagccauugcuugaauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56635 - RNA, 1410 nt, Artificial Sequence
  neuraminidase__InfluenzaA__BAF57595
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaauagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguugggcguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuugugucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacguucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56636 - RNA, 1410 nt, Artificial Sequence
  neuraminidase__InfluenzaA__BAF57599
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugaccagagaaccuuaugugucaugcgauccugacaagugcuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuugugugacgggggaugauaaaaaugcaacugcuagcuucauuuacaaugggaggcuuguagauaguauuguuucaugguccaaagaaauccucaggacccaggagucagaaugcguuuguaucgauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56637 - RNA, 1410 nt, Artificial Sequence
  neuraminidase__InfluenzaA__BAF57603
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaggaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccugauuccaaauugcagauaaauaggcaagucauaguugacagagguaauagguccgguuauucugguauuuucuccguugaaggcaaaagcugcaucaaucggugcuuuuauguggaguugauaaggggaagaaaagaggaaacugaagucuuggggaccucgaacaguauuguuguguuuuguggcaccucagguacauauggaacaggcucauggccugauggggcggacaucaaucucaugccuauauaa

SEQ ID NO: 56638 - RNA, 1410 nt, Artificial Sequence
  Neuraminidase__InfluenzaA__BAF62620
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacauaauaggaccccuuaucggaccuuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguugcgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 56639 - RNA, 1413 nt, Artificial Sequence
  neuraminidase__InfluenzaA__BAF63036
augaauccaaaucaaaaaauaauaaccauuggaucaaucaguauagcaaucggaauaauuagucuaauguugcaaauaggaaauauuauuucaauaugggcuagucacucaauccaaacuggaagucagaaccacacuggaauaugcaaccaaagaaucaucacauaugaaaacagcaccugggugaaucacacauauguuacuauuaacaacacuaauguuguugcuggaaaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguauuaaaauacaacggaauaauaacugaaaccauaaaaaguuggaaaaaacgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaccaaauaggauacaucugcaguggaguguucggugacaauccgcgucccaaagauggaaagggcagcuguaauccagugacuguugauggagcagacggaguaaaaggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaaggccuugcuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56640 - RNA, 1413 nt, Artificial Sequence; identical to SEQ ID NO: 51945
  neuraminidase__InfluenzaA__BAF63040

SEQ ID NO: 56641 - RNA, 1413 nt, Artificial Sequence
  neuraminidase__InfluenzaA__BAF63047
augaauccaaaucaaaaaauaauaaccauuggaucaaucaguauagcaaucggaauaauuagucuaguguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaauugaaugcacccaauuuucauuaugaggaauguuccuguuacccagacacuggcacaguaauguguguaugcagggacaacuggcaugguucaaaucgaccuugggugucuuuuaaucaaaacuuggauuaucaaauaggauacaucugcaguggaguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguuaauagugauacugcagacuggucuuggccagacggugcugaguugccguucaccauugacaaguag

SEQ ID NO: 56642 - RNA, 1413 nt, Artificial Sequence
  neuraminidase__InfluenzaA__BAF63058
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuugugcuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaaugaggccgccucguacaaaaucuucaagaucgaaaaggggaagguuacuaaaucaauagaguugaaugcacccaauuuucauuaugaggaaugcuccuguuacccagacacuggcacagugauguguguaugcagggacaacuggcaugguucaaaucgaccuugggugucuuuuaauccaaacuuggauuaucaaauaggauacaucugcaguggaguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugguuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuaaagaaaauacaacaaucuggacuagugggagcagcauuuccuuuuguggcguuaauagugacacugcaaacuggucuuggccagacggugcugaguugccguucaccauugacaaguag

SEQ ID NO: 56643 - RNA, 1413 nt, Artificial Sequence; identical to SEQ ID NO: 51945
  neuraminidase__InfluenzaA__BAF63065

SEQ ID NO: 56644 - RNA, 1413 nt, Artificial Sequence; identical to SEQ ID NO: 51945
  neuraminidase__InfluenzaA__BAF63069

SEQ ID NO: 56645 - RNA, 1413 nt, Artificial Sequence
  neuraminidase__InfluenzaA__BAF63079
augaauccaaaucaaaaaauaauaaccauuggaucaaucaguauagcaaucggaauaauuagucuaauguugcaaauaggaaauauuauuucaauaugggcuagucacucaauccaaacuggaauucaaaaccacacuggaauaugcaaccaaagaaucaucacauaugaaaacagcaccugggugaaucacacauauguuacuauuaacaacacuaauguuguugcuggaaaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaaugggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcauggcucaaaucgaccuugggugucuuuuaaucaaaacuuggauuaucaaauaggauacaucugcaguggaguguucggugacaauccgcgucccagagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucagcauccugaguuaacaggauuggacuguauaagaccuugcuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 56646 - RNA, 1413 nt, Artificial Sequence; identical to SEQ ID NO: 56645
  neuraminidase__InfluenzaA__BAF63092

SEQ ID NO: 56647 - RNA, 1413 nt, Artificial Sequence; identical to SEQ ID NO: 51945
  neuraminidase__InfluenzaA__BAF63098

SEQ ID NO: 56648 - RNA, 1413 nt, Artificial Sequence
  neuraminidase__InfluenzaA__BAF63104
augaauccaaaucaaaaaauaauaaccauuggaucaaucaguauagcaaucggaauaauuagucuaauguugcaaguaggaauaguuguuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucaguggcauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguauaaaaucuucaagaucgaaaaggggcagguuacuaaaucaguagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 56649 - RNA, 1413 nt, Artificial Sequence
  neuraminidase__InfluenzaA__BAF63112
augaauccaaaucaaaaaauaauaaccauuggaucaaucaguauagcaaucggaauaauuagucuaauguugcaaguaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucaguggcauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguauaaaaucuucaagaucgaaaaggggcagguuacuaaaucaguagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 56650 - RNA, 1413 nt, Artificial Sequence
  neuraminidase__InfluenzaA__BAF63116
augaauccaaaucaaaaaauaauaaccauuggaucaaucaguauagcaaucggaauaauuagucuaauguugcaaguaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucaguggcauuggccggcaauucaucucuuuguucuaucagugggugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggccugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucaugcuucaccauaaugaccgauggcccgaguaauggggccgccucguauaaaaucuucaagaucgaaaaggggcagguuacuaaaucaguagaguuaaaugcacccaauuuucauuaugaggaauguuccuguuacccagacacuggcacagugauguguguaugcagggacaacuggcaugguucaaaucgaccuugggugucuuuuaauccagacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 56651 - RNA, 1413 nt, Artificial Sequence
  neuraminidase__InfluenzaA__BAF63124
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagugcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaagagaguuaaaugcacccaauuuucauuaugaggaauguuccuguuacccagacacuggcacagugauguguguaugcagggacaacuggcaugguucaaaucgaccuugggugucuuuuaauccaaacuuggauuaucaaauaggauacaucugcaguggaguggucggugacaauccgcgucccaaagauggaaagggcagcuguaauccagugacugcugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 56652 - RNA, 1413 nt, Artificial Sequence
  neuraminidase__InfluenzaA__BAF63132
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagugcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaagagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacugcugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaauugccguucaccauugacaaguag

SEQ ID NO: 56653 - RNA, 1413 nt, Artificial Sequence
  neuraminidase__InfluenzaA__BAF63136
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaacucaucucuuuguucuaucaguggaugggcuauauacacaaaagacaacagcauacgaauuggcuccaaaggagauguuuuugucauaagagaaccuuucauaucauguucucacuuagaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauagaguugaaugcacccaauuuucauuaugaggaauguuccuguuacccagacacuggcacagugaugugcguaugcagggacaacuggcaugguucaaaucgaccuugggugucuuuuaaucaaaacuuggauuaucaaauaggauacaucugcaguggaguguucggggacaauccgcgucccaaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuuccuuuuguggcguuaauagugauacugcaaacuggucuuggccagacggugcugaguugccguucaccauugacaaguag

SEQ ID NO: 56654 - RNA, 1350 nt, Artificial Sequence
  neuraminidase__InfluenzaA__BAH24021
augaauccaaaucagaagauaauaaccauugggucaaucuguaugguaauuggaauaguuagcuuaauguuacaaauugggaacauggucucauuaugggucagucauucaauucagacagggaaucaacaccaaguugaaccaaucagcaauacuaauuuucuuacugagaaagcuguggcuucaguaacauuagcgggcaauucaucucuuugccccauuagaggaugggcuguacacaguaaggacaacaguauaaggauugguuccaaaggggauguguuuguuauuagagagccauucaucucaugcucccacuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugaaucuguugcuuggucagcaagugcuugccaugauggcaccaguugguugacaauuggaauuucuggcccagacaauggggcuguggcuguauugaaauacaauggaaugauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaagugguuaaaucagucgaauuggaugcuccuaauuaccacuaugaggaaugcuccuguuauccugaugccggcgaaaucacaugugugugcagggauaauuggcauggcucaaaucggccauggguaucuuucaaucaaaauuuggaguaucaaauaggauauauaugcagcggaguuuucggggacaauccacgccccaaugguggaacagguaguugugguccgguguccccuaauggggcauaugggguaaaaggguuuucauuuaaauacggcaaugguguuuggaucgggagaaccaaaagcccuaguuccaggagcggcuuugaaaugauuugggauccaaauggguggacugaaacggacaguagcuucucggugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauauccuuuugugguguaaauagugacacugugaguuggucuuggccagacggugcugaguugccauucaccauugacaaguaa

SEQ ID NO: 56655 - RNA, 1410 nt, Artificial Sequence; identical to SEQ ID NO: 47397
  neuraminidase__InfluenzaA__BAH95825

SEQ ID NO: 56656 - RNA, 1410 nt, Artificial Sequence; identical to SEQ ID NO: 47305
  neuraminidase__InfluenzaA__BAH95826

SEQ ID NO: 56657 - RNA, 1410 nt, Artificial Sequence
  neuraminidase__InfluenzaA__BAJ07994
augaauccaaaucagaagauaacaaccauuggaucaaucuguaugguaauuggaauaguuagcuugauguuacaaauugggaacauaaucucaauauggguuagucauucaauucaaacagggaaucaacaccaggcugaaccaugcaaucaaagcauuauuacuuaugaaaacaacaccuggguaaaccagacauaugucaacaucagcaauaccaauuuucuuacugagaaagcuguggcuucaguaacauuagcgggcaauucaucucuuugccccauuaguggaugggcuguauacaguaaggacaacgguauaagaaucgguuccaagggggauguguuuguuauaagagagccguucaucucaugcucccacuuggaaugcagaauuuucuuuuugacucagggagccuugcugaaugacaagcauucuaaugggaccgucaaagacagaagcccucacagaacauuaaugaguugucccgugggugaggcuccuuccccauacaacucgagguuugagucuguugcuuggucggcaagugcuugucaugauggcacuaguugguugacaauuggaauuucuggcccagacaauggggcuguggcuguauugaaauacaauggcauaauaacagacacuaucaagaguuggaggaacaacauaaugagaacucaagagucugaaugugcauguguaaauggcucuugcuuuacuguuaugacugauggaccaaguaaugggcaggcuucauacaaaaucuucagaauagaaaaagggaaaguaguuaaaucagccgaauuaaaugccccuaauuaucacuaugaggagugcuccuguuauccugaugcuggagaaaucacaugugugugcagggauaacuggcauggcucaaaucggccauggguaucuuucaaucaaaauuuggaguaucgaauaggauauauaugcaguggaguuuucggagacaauccacgccccaaugaugggacaggcaguugugguccgguguccccuaaaggggcauauggaauaaaaggguucucauuuaaauacggcaaugguguuuggaucgggagaaccaaaagcacuaauuccaggagcggcuuugaaaugauuugggauccaaauggauggacugguacggacaguaauuuuucaguaaagcaagauauuguagcuauaaccgauuggucaggauauagcgggaguuuuguccagcauccagaacugacaggauuagauugcauaagaccuuguuucugggucgagcuaaucagagggcggcccaaagagagcacaauuuggacuagugggagcagcauauccuuuugugguguaaauagugacacuguggguuggucuuggccagacggugcugaguugccauucaccauugacaaguag

SEQ ID NO: 56658 - RNA, 1350 nt, Artificial Sequence
  neuraminidase__InfluenzaA__BAK23415
augaauccaaaucagaagauaauaaccaucggaucagucuguaugauaauuggaauaguuagcuuaauguuacaaauugggaacaugaucucaauaugggucggucauucaauucagacagguaaucaaugccaugcugaaccaaucagcaauacuaaauuuccuacugagaaagcugcugcuucagugacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaggacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaguacaauggcauaauaacagacaccaucaagaguuggaggaacaacauacugagaacucaagagucugaaugugcauguauaaauggcucuugcuuuacuguaaugacugauggaccaaguagugggcaggcaucauauaaaaucuucaaaauggaaaaggggaaggugguuaaaucagucgaauuggaugccccuaauuaucacuaugaggagugcuccuguuauccugaugccggcgaaaucacaugugugugcagagauaauuggcauggaucaaauaggccauggguaucuuucaaucaaaauuuggaguaucaaauaggauauauaugcaguggaguuuucggagacaauccacgcccaaaugauggaacagguaguugugguccgguguccccuaacggggccuaugggguaaaaggguuuucauuuaaauacggcaaugguguuuggaucgggagaaccaaaagcacuaauuccaggagcggcuuugaaaugauuugggacccaaauggguggacuggaacggacaguaguuuuucgguaaagcaagauaucguagcaauaacugauuggucuggauauagugggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 56659 - RNA, 1350 nt, Artificial Sequence
  neuraminidase__InfluenzaA__BAK23416
augaauccaaaucagaagauaauaaccaucggaucaaucuguaugguaauuggaauaguuagcuuaauguuacaaauugggaacaugaucucaauaugggucagucauucaauucagacagggaaucaaugccaagcugaaccaaucagcaauacuaaauuucuuacugagaaagcuguggcuucaguaacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaaguaguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccggcguccccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 56660 - RNA, 1350 nt, Artificial Sequence
  neuraminidase__InfluenzaA__BAK23417
augaauccaaaucagaagauaauaaccaucggaucaaucuguaugguaauuggaauaguuagcuuaauguuacagauugggaacaugaucucaauaugggucagucauucaauucagacagggaaucaaugccaaucugaaccgaucagcaauacuaaauuucuuacugagaaagcuguggcuucaguaacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcuagugcuugccaugauggcaucaguugguugacaauuggaauuucugguccagacaauggggcuguggcuguauugaaauacaauggcauaauaacagacaccaucaagaguuggaggaacaacauacuaagaacucaagaaucugaaugugcauguguaaauggcucuugcuuuacuguaaugacugauggaccaaguagugggcaggcaucauauaagaucuucaaaauggaaaaagggaaagugguuaaaucagucgaauuggaugcuccuaauuaucacuaugaggagugcuccuguuauccugaugccggcgaaaucacauguguguguagggauaauuggcauggcucaaauaggccauggguaucuuucaaucaaaaucuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagugggaguuuuguccagcauccagaacugacaggauuagauugcauaagaccuuguuucuggguugaguuaaucagagggcggccuaaagagagcacaauuuggaccaguggaagcagcauauccuuuugugguguaaacggugacacuguuaguuggucuuggccagacggugcugaguugccauucaccauugacaaguag

SEQ ID NO: 56661 - RNA, 1350 nt, Artificial Sequence
  neuraminidase__InfluenzaA__BAK23418
augaauccaaaucagacgauaauaaccaucggaucaaucuguaugguaauuggaauaguuagcuuaauguuacaaauugggaacaugaucucaauaugggucagucauucaauucagacagggaaucaaugccaagcugaaccaaucagcaauacuaaauuucuuacugagaaagcuguggcuucaguaacauuagcgggcaauucaucucuuugucccauuagcggaugggcuguauacaguaaagacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuucacuguaaugacugauggaccaaguagugggcaggcaucauauaagaucuucaaaauggaaaaggggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugcgguccgguuuccccuaacggggcauaugggguaaaaggguuuucauuuaaauauggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggacuaguggaagcagcauaucuuuuugugguguaaauagugacacuguuaguuggucuuggccagacggugcugaguugccauucaccauugacaaguag

SEQ ID NO: 56662 - RNA, 1350 nt, Artificial Sequence
  neuraminidase__InfluenzaA__BAK23420
augaauccaaaucagaagauaauaaccaucggaucaaucuguaugguaauuggaauaguuagcuuaauguuacaaauugggaacaugaucucaauaugggucagucauucaauucagacagggaaucaaugccaagcugaaccaaucagcaauacuaaauuucuuacugagaaagcuguggcuucaguaacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 56663 - RNA, 1350 nt, Artificial Sequence; identical to SEQ ID NO: 56662
  neuraminidase__InfluenzaA__BAK23421

SEQ ID NO: 56664 - RNA, 1350 nt, Artificial Sequence
  neuraminidase__InfluenzaA__BAK23422
augaauccaaaucagaagauaauaaccaucggaucagucuguaugguaauuggaauaguuagcuuaauguuacaaauugggaacaugaucucaauaugggucggucauucaauucagacagggaaucaaugccaugcugaaccaaucagcaauacuaaauuuccuacugagaaagcugcugcuucagugacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacguuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaguacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 56665 - RNA, 1350 nt, Artificial Sequence
  neuraminidase__InfluenzaA__BAK23423
augaauccaaaucagaagauaauaaccaucggaucaaucuguaugguaauuggaauaguuagcuuaauguuacagauugggaacaugaucucaauaugggucagucauucaauucagacagggaaucaaugccaagcugaaccgaucagcacuacuaaauuucuuacugagaaagcuguggcuucaguaacauuagcgggcaauucaucucuuugucccauuagcggaugggcuguauacaguaaggacaacaguauaaggaucggucccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcuagugcuugccaugauggcaucaguugguugacaauuggaauuucugguccagacaauggggcuguggcuguauugaaauacaauggcauaauaacagacaccaucaagaguuggaggaacaacauacuaagaacucaagaaucugaaugugcauguguaaauggcucuugcuuuacuguaaugacugauggaccaaguagugggcaggcaucauauaagaucuucaaaauggaaaaagggaaagugguuaaaucagucgaauuggaugcuccuaauuaucacuaugaggagugcuccuguuauccugaugccggcgaaaucacauguguguguagggauaauuggcauggcucaaauaggccauggguaucuuucaaucaaaaucuggaguaucaaauaggauauauaugcaguggaguuuucggagacaauccacgccccaaugauggaacagguaguugugguccgguguccccuaacggggcauaugggguaaaaggguuuucauuuaaauacggaaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagugggaguuuuguccagcauccagaacugacaggauuagauugcauaagaccuuguuucuggguugaguuaaucagagggcggccuaaagagagcacaauuuggaccaguggaagcagcauauccuuuugugguguaaauagugacacuguuaguuggucuuggccagacggugcugaguugccauucaccauugacaaguag

SEQ ID NO: 56666 - RNA, 1350 nt, Artificial Sequence
  neuraminidase__InfluenzaA__BAK23424
augaauccaaaucagaagauaauaaccaucggaucaaucuguaugguaauuggaauaguuagcuuaauguuacaaauugggaacaugaucucaauaugggucagccauucaauucagacaggaaaucaaugccaaggugaaccaaucagcaacacuaaauuucuuacugagaaagcuguggcuucaguaacauuagcgggcaauucaucucuuuguccuauuagcggaugggcuguauacaguaaggacaacaguauaaggaucggcuccaggggagauguguuuguuauaagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaaucucugguccagacaauggagcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggaaugcuccuguuauccugaugccggcgaaaucacaugugugugcagggauaauuggcaugguucaaauaggccauggguaucuuucaaucaaaauuuggaguaucaaauaggauauauaugcaguggaguuuucggagacaauccacgccccaaugauggaacagguaguugugguccaguguucucuaauggggcauaugggguaaaaggguuuucguuuaaauacggcaaugguguuuggaucgggagaaccaaaagcacuaauucuaggagcggcuuugaaaugauuugggaccccaauggguggacuggaacggacaguagcuuuucggggaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 56667 - RNA, 1350 nt, Artificial Sequence
  neuraminidase__InfluenzaA__BAK23425
augaauccaaaucagaagauaauaaccaucggaucaaucuguaugguaauuggaauaguuagcuuaauguuacagauugggaacaugaucucaauaugggucagucauucaauucagacagggaaucaaugccaagcugaaccgaucagcaauacuaaauuucuuacugagaaagcuguggcuucaguaacauuagcgggcaauucaucucuuugucccauuagcggaugggcgguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcuagugccugccaugauggcaucaguugguugacaauuggaauuucugguccagacaauggggcuguggcuguauugaaauacaauggcauaauaacagacaccaucaagaguuggaggaacaacauauuaagaacucaagaaucugaaugugcauguguaaauggcucuugcuuuacuguaaugacugauggaccaaguagugggcaggcaucauauaagaucuucaaaauggaaaaagggaaagugguuaaaucagucgaauuggaugcuccuaauuaucacuaugaggagugcuccuguuauccugaugccggcgaaaucacauguguguguagggauaauuggcauggcucaaauaggccauggguaucuuucaaucaaaaucuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggagaaccaaaagcacuaauuccaggagcggcuuugaaaugauuugggacccaaauggguggauuggaacggacaguagcuuuucggugaagcaagauaucguagcaauaacugauuggucgggauauagugggaguuuuguccagcauccagaacugacaggauuagauugcauaaggccuuguuucuggguugaguuaaucagagggcggccuaaagagagcacaauuuggaccaguggaagcagcauauccuuuugugguguaaauagugacacuguuaguuggucuuggccagacggugcugaguugccauucaccauugacaaguag

SEQ ID NO: 56668 - RNA, 1350 nt, Artificial Sequence
  neuraminidase__InfluenzaA__BAK23426
augaauccaaaucagaagauaauaaccaucggaucaaucuguaugguaauuggaauaguuagcuuaauguuacaaauugggaacaugaucucaauaugggucagucauucaauucagacagggaaucaaugccaagcugaaccaaucagcaauacuaaauuuuuuacugagaaagcuguggcuucaguaacauuagcgggcaauucaucucuuugccccauuagcggaugggcuguauacaguaaggacaacaguauaaggaucgguuccaggggggauguguuuauuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccguauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 56669 - RNA, 1350 nt, Artificial Sequence; identical to SEQ ID NO: 56667
  neuraminidase__InfluenzaA__BAK23427

SEQ ID NO: 56670 - RNA, 1350 nt, Artificial Sequence
  neuraminidase__InfluenzaA__BAK23428
augaauccaaaucagaagauaauaaccaucggaucaaucuguaugguaauuggaauaguuagcuuaauguugcaaauugggaacaugaucucaauaugggucagucauucaauucagacagggaaucaaugccaagcugaaccaaucagcaauacuaaauuucuuacugagaaagcuguggcuucaguaacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcguuucggugaagcaagauaucguagcaauaacugauuggucaggauauagcggaaguuuuguccagcauccagaacugacaggauuagauugcauaagaccuuguuucaggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 56671 - RNA, 1350 nt, Artificial Sequence; identical to SEQ ID NO: 56667
  neuraminidase__InfluenzaA__BAK23429

SEQ ID NO: 56672 - RNA, 1350 nt, Artificial Sequence
  neuraminidase__InfluenzaA__BAK23430
augaauccaaaucagaagauaauaaccaucggaucaaucuguaugguaauuggaauaguuagcuuaauguuacagauugggaacaugaucucaauaugggucagucauucaauucagacagggaaucaaugccaagcugaaccgaucagcaauacuaaauuucuuacugagaaagcuguggcuucaguaacauuagcgggcaauucaucucuuugucccauuagcggaugggcgguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcuagugccugccaugauggcaucaguugguugacaauuggaauuucugguccagacaauggggcuguggcuguauugaaauacaauggcauaauaacagacaccaucaagaguuggaggaacaacauauuaagaacucaagaaucugaaugugcauguguaaauggcucuugcuuuacuguaaugacugauggaccaaguagugggcaggcaucauauaagaucuucaaaauggaaaaagggaaagugguuaaaucagucgaauuggaugcuccuaauuaucacuaugaggagugcuccuguuauccugaugccggcgaaaucacauguguguguagggauaauuggcauggcucaaauaggccauggguaucuuucaaucaaaaucuggaguaucaaauaggauauauaugcaguggaguguucggagacaauccacgccccaaugauggaacagguaguugugguccgguguccccuaacggggcauaugggguaaaaggguuuucauuuaaauacggcaaugguguuuggaucgggagaaccaaaagcacuaauuccaggagcggcuuugaaaugauuugggacccaaauggguggauuggaacggacaguagcuuuucggugaagcaagauaucguagcaauaacugauuggucgggauauagugggaguuuuguccagcauccagaacugacaggauuagauugcaugaggccuuguuucuggguugaguuaaucagagggcggccuaaagagagcacaauuuggaccaguggaagcagcauauccuuuugugguguaaauagugacacuguuaguuggucuuggccagacggugcugaguugccauucaccauugacaaguag

SEQ ID NO: 56673 - RNA, 1350 nt, Artificial Sequence
  neuraminidase__InfluenzaA__BAK23431
augaauccaaaucagaagauaauaaccaucggaucaaucuguaugguaauuggaauaguuagcuuaauguuacaaauugggaacaugaucucaauaugggucagucauucaauucagacagggaaucaaugccaagcugaaccaaucagcaauacuaaauuucuuacugagaaagcuguggcuucaguaacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaacgguguuuggaucgggagaaccaaaagcacuaauuccaggagcggcuuugaaaugauuuggggcccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 56674 - RNA, 1350 nt, Artificial Sequence; identical to SEQ ID NO: 56667
  neuraminidase__InfluenzaA__BAK23432

SEQ ID NO: 56675 - RNA, 1350 nt, Artificial Sequence; identical to SEQ ID NO: 56667
  neuraminidase__InfluenzaA__BAK23433

SEQ ID NO: 56676 - RNA, 1410 nt, Artificial Sequence
  neuraminidase__InfluenzaA__BAM65748
augaauccaaaucaaaagauaauaacgauuggaucuguuucucuaacuauuuccacaauaugcuucuucaugcaaauugccaucuuaauaacuacuguaacauugcauuucaagcaauaugaauucaacucccccccaaacaaccaagugaugcugugugaaccaacaauaauagaaagaaacauaacagagauaguguaucugaccaacacuaccauagagaaggaaauaugccccaaacuagcagaauacagaaauuggucaaagccgcaaugugacauuacaggauuugcaccuuuuucuaaggacaauucgauuaggcuuuccgcugguggggacauuugggugacaagagaaccuuaugugucaugcgauccugacaaguguuuucaauuugcccuuggacagggaacaacacuaaacaacgugcauucaaaugacacaguacaugauaggaccccuuaccggacccuauugaugaaugaguuagguguuccauuucaucuggggaccaagcaagugugcauagcaugguccagcucaaguugucacgauggaaaagcauggcugcauguuuguguaacgggagaugauaaaaaugcaacugcuaguuucauuuacaaugggaggcuaguagauaguauuguuucaugguccaaaaaaauacucaggacccaggagucagaauguguuuguaucaauggaacuuguacaguaguaaugacugaugggagugcuucaggaaaagcugauacuaaaauacuauucauugaggaggggaaaaucguucauacuagcacauuaucaggaagugcucagcaugucgaggagugcuccugcuauccucgauauccuggugucagaugugucuguagagacaacuggaaaggcuccaauaggcccaucguagauauaaacauaaaggauuauagcauuguuuccaguuaugugugcucaggacuuguuggagacacacccagaaaaaccgacagcuccagcaguagccauugcuuagauccuaacaaugaagaagguggucauggagugaaaggcugggccuuugacgauggaaaugacguguggaugggaagaacaaucagcgagaagucacgcuuaggauaugaaacauucaaagucauuggaggcugguccaacccuaauuccaaaucacagauaaauaggcaagucauaguugacauggguaauagguccgguuauucugguauuuucucuguugaaggcaaaagcugcaucaaucggugcuuuuauguggaguugauaaggggaagaaaagaugaaacugaagucuuguggaccucaaacaguauuguuguguuuuguggcaccucagguacauauggaacaggcucauggccugauggggcggacaucaaacucaugucuauauaa

SEQ ID NO: 56677 - RNA, 1350 nt, Artificial Sequence
  neuraminidase__InfluenzaA__BAM85817
augaauccaaaucagaagauaauaaccaucggaucaaucuguaugguaacuggaauaguuagcuuaauguuacaaauugggaacaugaucucaauaugggucagucauucaauucacacagggaaucaacaccaaucugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacgauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccuaaugccggagaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 56678 - RNA, 1350 nt, Artificial Sequence
  neuraminidase__InfluenzaA__BAM85818
augaauccaaaucagaagauaauaaccauuggaucaaucuguaugguaauuggaauaguuagcuuaauguuacagauugggaacaugaucucaauaugggucagucauucaauucaaacagggaaucaacaccaagcugaaccaaucagaaauacuaauuuucuuacugagaacgcuguggcuucaguaacauuagcgggcaauucaucucuuugccccauuagaggaugggcuguacacaguaaagacaacaguauaaggauugguuccaagggggauguguuuguaauuagagagccguucaucucaugcucccauuuggaaugcagaacuuucuuuuugacucagggagccuuacugaaugacaagcacuccaacgggacugucaaagacagaagcccucacagaacacuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugacggaccaaguaauggacaggcaucauauaagaucuucaaaauggaaaaagggaaaguaguuaaaucagucgaauugaaugcuccuaauuaucacuaugaggaaugcuccuguuauccugaugcuggcgaaaucauaugugugugcagggauaauuggcauggcucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaauggguggacuggaacggacaguaacuuuucggugaaacaagauauaguagcaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 56679 - RNA, 1350 nt, Artificial Sequence
  neuraminidase__InfluenzaA__BAM85819
augaauccaaaucaaaagauaauaaccauugggucaaucuguaugguaauuggaauaguuagcuuaauguugcaaauugggaacaugaucucaauaugggucagucauucaauucagacagggaaucaaaaccaaguugagccaaucaucaauacuaauuuucuuacugagaaagcuguggcuucaauaacauuagcgggcaauucaucucuuugcccuauuagaggaugggcuauacacaguaaggacaacaguauaaggauugguuccaagggggauguguuuguuauuagagagccauucaucucaugcucucacuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccggacaauggggcuguggcuguauugaaauacaauggcauaauaacagacaccaucaagagcuggaggaacaacauauugagaacucaagaguccgaaugugcaugcguaaauggcucuugcuuuacuguaaugacugacggaccaagugaugggcaggcaucauauaagaucuucaaaauggaaaaagggaaaguaauuaaaucagucgaauuggaugcuccuaauuaccacuaugaggaaugcuccuguuauccugaugccggugaaaucacaugugugugcagagauaauuggcauggcucaaaucggccauggguguccuucaaucaaaaucuggaguaucaaauaggguauauaugcaguggaguuuucggagacaauccacguccuaacgauggaacagguaguugugguccggugucccauaauggggcauaugggguaaaaggguuuucauuuaaauacggcaaugguguuuggaucgggagaaccaaaagcccuaauuccaggagcggcuuugaaaugauuugggauccaaauggguggagugaaacggacaguagcuucucggugaaacaagauauaguagcaauaaccgauuggucaggauauagcgggaguuuuguccagcauccagaacugacagguuuagauugcauaagaccuuguuucuggguugaguuaaucagagggcggcccaaagagaguacaguuuggacuagugggagcagcauauccuuuugugguguaaguagugacacugugaguuggucuuggccagacggugcugaguugccauucaccauugacaaguaa

SEQ ID NO: 56680 - RNA, 1350 nt, Artificial Sequence
  neuraminidase__InfluenzaA__BAM85820
augaauccaaaucagaagauaauaaccaucggaucaaucuguaugguaauuggaauaguuagcuuaauguuacaaauugggaacaugaucucaauaugggucagucauucaauucagacagggaaucaacaccaagcugaaccaaucagcaauacuaauuuucuuacugagaaagcuguggcuucaguaacauuagcgggcaauucaucucuuugccccauuagaggaugggcuguacacaguaaggacaacaguauaaggaucgguuccaagggggauguguuuguuauuagagagccguucaucucaugcucccacuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggagaaccaaaagcacuaauuccaggagcggcuuugaaaugauuugggauccaaauggguggacuggaacggacaguagcuuuucggugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 56681 - RNA, 1350 nt, Artificial Sequence
  neuraminidase__InfluenzaA__BAM85821
augaauccaaaucagaagauaauaaccaucggaucaaucuguaugguaacuggaauaguuagcuuaauguuacaaauugggaacaugaucucaauaugggucagucauucaauucacacagggaaucaacaccaagcugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauucuaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 56682 - RNA, 1350 nt, Artificial Sequence
  neuraminidase__InfluenzaA__BAM85822
augaauccaaaucagaagauaauaaccaucggaucaaucuguaugguaacuggaauaguuagcuuaauguuacaaauugggaacaugaucucaauaugggucagucauucaauucacacagggaaucaacaccaaucugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucugucgcuuggucagcaagugcuugccaugauggcaccaguugguugacaauugguauuucuggcccagacaauggggcuguggcuguagugaaguacaauggcauaauaacagacacuaucaagaguuggaggaacaacauacugagaacucaagagucugagugugcauguguaaauggcucuugcuuuacuguaaugacugacggaccaaguaauagucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccaugggugucuuucaaucaaaauuuggaguaucaaauaggauauauaugcaguggaguuuucggagacaauccacgccccaaugauggaacagguaguugugguccgguguccucuaacggggcauaugggguaaaagguuuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucauuuugugguguaaauagugacacuguggguuggucuuggccagacggugcugaguugccauucaccauugacaaguag

SEQ ID NO: 56683 - RNA, 1410 nt, Artificial Sequence
  neuraminidase__InfluenzaA__BAM85823
augaauccaaaucagaagauaacaaccauuggaucaaucuguaugguaauuggaauaguuagcuugauguugcagauugggaacauaaucucaauauggguuagucauucaauucagacagggaaucaacaccaggcuggaccaugcaaucaaagcauuauuacuuaugaaaacaacaccuggguaaaucagacauaugucaacaucagcaauaccaauuuucuuacugagaaaacuguggcuucaguaacauuagcgggcaauucaucucuuugccccauuaguggaugggcuguauacaguaaggacaacgguauaagaaucgguuccaagggggauguguuuguuauaagagagccguucaucucaugcucccacuuggaaugcagaacuuucuuuuugacucagggagccuugcugaaugacaagcauucuaaugggaccgucaaagacagaagcccucacagaacauuaaugaguuguccugugggugaggcuccuuccccauauaacucgagguuugagucuguugcuuggucagcaagugcuugucaugauggcauuaauugguugacaauuggaauuucuggcccagacaauggggcuguggcuguauugaaauacaaugguauaauaacagacacuaucaagaguuggaggaacaacauacugagaacucaagagucugaaugugcauguguaaauggcucuugcuuuacuauaaugacugauggaccaaguaacgggcaggcuucauauaaaaucuucagaauagaaaaagggaaaguaguuaaaucagucgaauugaacgccccuaauuaucacuaugaggagugcuccuguuauccugaugcuggcgaaaucacaugugugugcagggauaauuggcauggcucaaaucggccauggguaucuuucaaucagaauuuggaguaucaaauaggauauauaugcaguggaauuuucggagacaauccacgccccaaugaugggacaggcaguugugguccgguguccccuaacggggcauauggaauaaagggguuuucauuuaaauacggcaaugguguuuggaucgggagaaccaaaagcacuaauuccaggagcggcuuugaaaugauuugggauccaaauggguggacuggaacggacaguaauuuuucggugaagcaagauaucguagcuauaacugauuggucaggauauagcgggaguuuuguccagcauccagaacugacaggauuagauugcauaagaccuuguuucuggguugagcuaaucagagggcggcccaaagagagcacaauuuggacuagugggagcagcauauccuuuugugguguaaacagugacacuguggguuggucuuggccagacggugcugaguugccauucaccauugacaaguag

SEQ ID NO: 56684 - RNA, 1350 nt, Artificial Sequence
  neuraminidase__InfluenzaA__BAM85824
augaauccaaaucagaagauaauaaccauuggaucaaucuguaugguaauuggaauagucagcuuacuguuacaaauugggaacaugaucucaauauggaucagucauucaauucagacaggaaaucaacaccaagcugaaucaaucagcaauacuaacccucuuacugaaaaagcuguggcuucaguaacauuagcgggcaauucaucucuuugccccauuagaggaugggcuguacacaguaaggacaacaguauaaggaucgguuccaagggggauguguuuguuauuagagagccguucaucucaugcucccacuuggaaugcagaacuuucuuuuugacucagggagccuugcugaaugacaagcacuccaacgggacugucaaagacagaagcccucacagaacauugaugaguuguccugugggugaggcucccuccccauauaacucaagguuugagucuguugcuuggucagcaagugcuugccaugauggcaccaguugguuaacaauugggauuucuggcccagacaauggggcuguggcuguguugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaagugguuaaaucagucgaauuggaugcuccuaauuaucacuaugaggagugcuccugcuauccugaugccagcgaaaucacaugugugugcagggauaacuggcauggcucaaauaggccauggguaucuuucaaucaaaauuuggaguaucaaauaggauauauaugcaguggaguuuucggagauaauccacgccccaaugauggaacagguaguugugguccgauguucccuaacggggcauaugggauaaaaggguuuucauuuaaauacggcaaugguguuuggaucgggagaaccaaaagcacuaauuccaggagcggcuuugaaaugauuugggauccaaauggguggacuggaacggacaguagcuuuucggugaaacaggauauaguagcaauaacugauuggucaggauauagugggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 56685 - RNA, 1350 nt, Artificial Sequence
  neuraminidase__InfluenzaA__BAM85825
augaauccaaaucaaaagauaauaaccauugggucaaucuguaugguaauuggaauaguuagcuuaauguugcaaauugggaacaugaucucaauaugggucagucauucaauucagacagggaaucaaaaccaaguugagccaaucaucaauacuaauuuucuuacugagaaagcuguggcuucaauaacauuagcgggcaauucaucucuuugcccuauuagaggaugggcuauacacaguaaggacaacaguauaaggauugguuccaagggggauguguuuguuauuagagagccauucaucucaugcucccacuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccggacaauggggcuguggcuguauugaaauacaauggcauaauaacagacaccaucaagagcuggaggaacaacauacugagaacucaagaguccgaaugugcaugcguaaauggcucuugcuuuacuguaaugacugacggaccaaguaaugggcaggcaucauauaagaucuucaaaauggaaaaggggaaaguaauuaaaucagucgaauuggaugcuccuaauuaccacuaugaggaaugcuccuguuauccugaugccggcgaaaucacaugugugugcagagauaauuggcauggcucaaaucggccauggguguccuucaaucaaaaucuggaguaucaaauaggauauauaugcaguggaguuuucggagacaauccacgccccaaugauggaacagguaguugugguccggugucccauaauggggcauaugggguaaaaggguuuucauuuaaauacggcaaugguguuuggaucgggagaaccaaaagcccuaauuccaggagcggcuuugaaaugauuugggauccaaauggguggagugaaacggacaguagcuucucggugaaacaagauauaguagcaauaacugauuggucaggauauagcgggaguuuuguccagcauccagaacugacagguuuagauugcauaagaccuuguuucuggguugaguuaaucagagggcggcccaaagagaguacaguuuggacuagugggagcagcauauccuuuugugguguaaauagugacacugugaguuggucuuggccagacggugcugaguugccauucaccauugacaaguaa

SEQ ID NO: 56686 - RNA, 1350 nt, Artificial Sequence
  neuraminidase__InfluenzaA__BAM85826
augaauccaaaucagaagauaauaaccaucggaucaaucuguaugguaauuggaauaguuagcuuaauguuacaaauugggaauaugaucucaauaugggucagucauucaauucagacagggaaucaacgccaagcugaaccaaucagcaauacuaaauuucuuacugagaaagcuguggcuucaguaacauuagcgggcaauucaucucuuugccccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacccaagagucugaaugugcauguguaaacggcucuugcuuuacuguaaugacugauggaccaaguaaugggcaggcaucauauaagaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccggugucccuuaacggggcauaugggguaaaaggguuuucauucaaauacggcaaugguguuuggauugggagaaccaaaagcacuaauuccaggagcggcuuugaaaugauuugggauccaaauggguggacuggaacggacaguagcuuuucggugaagcaagauaucguagcaauaacugauuggucaggauauagcgggaguuuuguccagcauccagaauugacaggauuagauugcauaagaccuuguuucuggguugaguuaaucagagggcggccuaaagagagcacaauuuggaccagugggagcagcauaucuuuuugugguguaaauagugacacuguuaguuggucuuggccagacggugcugaauugccauucaccauugacaaguag

SEQ ID NO: 56687 - RNA, 1350 nt, Artificial Sequence
  neuraminidase__InfluenzaA__BAM85827
augaauccaaaucagaagauaauaaccauuggaucaaucuguaugguaauuggaguaguuagcuuaauguuacaaaccgggaacauaaucucaauaugggucagucauucaauucagaaagggaaucaacaccaagcugaaucaaucagcaauacuaacccucuuacugagaaagcuguagcuucaguaacauuagcgggcaauucaucucuuugccccauuagaggaugggcuguacacaguaaggacaacaauauaaggaucgguucuaagggggauguguuuguuauuagagagccguucaucucaugcucucaccuggaaugcagaacuuuuuucuuaacucagggagccuugcuaaaugacaagcacuccaacgggacugucaaagacagaagcccucacagaacauuaaugaguuguccugugggugaggcucccucuccauauaacucaagauuugagucuguugcuuggucagcuagugcuugccaugauggcaccaguugguugacaauuggaauuucuggcccagacaaugaggcuguggcuguauugaaguacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaaguagucaaaucagucgaauuggaugcuccuaauuaucacuaugaggagugcuccuguuauccugacgccggcgaaaucacaugcguuuguagggauaauuggcauggcucaaaucguccauggguaucuuucaaucaaaauuuggaguaucaaauaggauauauaugcaguggaguuuucggagacaauccacgccccaaugauggaacaggcaguuguggcccgauguccccuaacggggcauaugggguaaaaggguuuucauuuaaauacggcaaugguguuuggaucgggagaaccaaaagcacuaccuccaggagcggcuuugaaaugauuugggauccaaauggguggacuggaacggacaguagcuuuucagugaaacaagauauaguagcaauaacugauuggucaggauauagcgggaguuuuguucagcauccagaacugacaggacuagacugcauaagaccuuguuucuggguugaguuaaucagagggcggcccaaagagaguacaauuuggacuagugggagcagcauauccuuuugugguguagauagugacacugugaguuggucuuggccagacggugcugaguugccauucaccauugacaaguag

SEQ ID NO: 56688 - RNA, 1350 nt, Artificial Sequence
  neuraminidase__InfluenzaA__BAM85828
augaauccaaaucagaagauaauaaccaucggaucaaucuguaugguaauuggaauaguuagcuuaauguuacaaauugggaacaugaucucaauaugggucagucauucaauucagacagggaaucaacgccaagcugaaccaaucagcaauacuaaauuucuuacugagaaagcuguggcuucaguaacauuagcgggcaauucaucucuuugccccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaauggugucuggaucgggagaaccaaaagcacuaauuccaggagcggcuuugaaaugauuugggauccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccagugggagcagcauaucuuuuugugguguaaauagugacacuguuaguuggucuuggccagacggugcugaguugccauucaccauugacaaguag

SEQ ID NO: 56689 - RNA, 1350 nt, Artificial Sequence
  neuraminidase__InfluenzaA__BAM85829
augaauccaaaucagaagauaauaacuaucggaucaaucuguaugauaauuggaauaguuagcuugauguuacaaauugggaacauaaucucaauaugggucagucauucaauucagacagggaaccaacaccaagcugaaccaaucagcgauacuaauuuucuuacugagaaagcuguggcuucaguaauacuagcgggcaauucaucucuuugccacauuaguggaugggcaguacacaguaaggacaacaguauaaggaucgguuccaagggggauguguuuguuauaagagagccguucaucucaugcucccacuuggagugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucggcaagugcuugccaugauggcaccaguugguugacaauuggaauuucuggcccagacaauggggcuguggcuguauugaaauacaauggcauaauaacagacaccaucaagaguuggaggaacuacauacugagaacucaagagucugaaugugcguguguaaauggcucuugcuuuaccguaaugacugauggaccaaguaaugggcaggcaucauauaagaucuucaaaauagaaaaagggaaagugguuaaaucagucgaauuagaugcuccuaauuaucacuaugaggaguguuccuguuauccugaugccggcgaaaucacaugugugugcagggauaauuggcauggcucaaaucggccauggguaucuuucaaucaaaacuuggaguaucaaauaggauauauaugcagugggguuuucggagacacuccacgccccaaugauggaacaggcaguuguggucccguguccccaaauggggcauaugggguaaaaggguuuucauuuaaauacggcaaugguguuuggaucgggagaaccaaaagcacuaauuccaggagcggcuuugaaaugauuugggauccaaauggguggacuggaacggacagcagcuuuucggugaaacaagaucucguagcaauaacugauuggucaggauauagcgggaguuucguucagcauccagaacugacaggauuagauugcauaagaccuuguuucuggguugagcugaucagagggcggcccaaagagagcacaauuuggacgagugggagcagcauauccuuuugugguguaaauagugacacuguggguuggucuuggccagacggugcugaguugccauucaccauugacaaguag

SEQ ID NO: 56690 - RNA, 1413 nt, Artificial Sequence
  neuraminidase__InfluenzaA__BAM85830
augaacccaaaucagaaaauaauaaccauuggaucaaucuguauggcaaucggaacaaucagucuaauacugcaaauagggaauauuaucucaauauggauuagccacucaauucaaacuggaagucaaaaccauacuggaauaugcaaccaaagaaucauuaccuaugaaaauaauaccuggguaaaucaaacauauguuaauauuagcaacacuaacguuguugcuggaaaggacacaacuucaaugauauuagccggcaauucaucucuuuguccuauccgugggugggcuauauacagcaaggacaacagcauaagaauugguuccaaaggagauguuuuugucauaagagaaccuuuuauaucaugcucucacuuggaaugcagaaccuuuuuucugacccaaggcgcucuauuaaaugacaagcauucaaaugggaccguuaaggacagaagcccuuauagggccuuaaugagcuguccuaucggugaagcuccgucuccguacaauucaagauuugaaucgguugcuuggucagcgagugcaugucaugauggcaugggcuggcuaacaaucggaauuucugguccagaugauggagcaguggcuguauuaaaauacaacggcauaauaacugaaaucauuaaaaguuggaggaagcaaauauuaagaacacaagagucugaaugugucuguguaaacgguucauguuuuaccauaaugaccgaugguccgaguaaugggccggccucguacagaaucuucaaaaucaagaaggggaagauuacuaaaucaauagaguuggaugcaccuaauucucauuacgaggaauguuccuguuacccagacaccggcaaagugaugugugugugcagagacaauuggcaugguucgaaucgaccaugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacaguuccagaaagggguuugagaugauuugggauccuaauggguggacagauaccgaugguaauuucuuagugaaacaggauguaguggcaaugacugauuggucaggguauagcggaaguuucguucaacauccugagcuaacaggauuggacuguaugaggccuugcuucuggguugaauuaaucagaggacaacccagagaaaaaacaacaaucuggacuagugggagcagcauuucuuuuuguggcgugaauagugauacuguaaauuggucuuggccagacggugccgaguugccauucaccauugacaaguag

SEQ ID NO: 56691 - RNA, 1413 nt, Artificial Sequence
  neuraminidase__InfluenzaA__BAM85831
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccgucaaggacagaagucccuauagggcuuuaaugagcuguccucuaggugaagcuccguccccauacaauucaaaguuugaaucaguugcuuggucagcaagcgcaugccaugauggcauaggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccagagauggagagggcagcuguaauccagugacugcugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauugggcuguauaagaccuugcuucuggguugaguuagucagaggacugccuagagaaaauacgacaaucuggacuagugggagcagcauuucuuuuuguggcguaaauagugauacugcaaacuggucuuggccagacggugcugaguugccguucaccauugacaaguag

SEQ ID NO: 56692 - RNA, 1413 nt, Artificial Sequence
  neuraminidase__InfluenzaA__BAM85832
augaacccaaaucaaaaaauaauaaccauuggaucaaucaguauagcaaucggaauaauuagucuaauguugcaaauaggaaauauuauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggucggcaacucaucucuuuguucuaucaguggaugggcuauauacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaaaguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuaguggaagcagcauuucuuuuuguggcguuaauggugauauugcaaauuggucuuggccagacggugcugaguugccguucaccauugacaaguag

SEQ ID NO: 56693 - RNA, 1410 nt, Artificial Sequence
  neuraminidase__InfluenzaA__BAM85833
augaauccaaaucagaaaauaauaaccauugggucaaccuguaugguaauuggaauaauaagccuaauauuacaaauugggaacauaaucucaauauggguuagccauucaauucagacugggaaucaaaaccaaccugaaacaugcaaccagagcgucauuaccuaugagaacaaaacuuggguaaaucagacauauguuaacaucagcaauaccaaucuugucauugagcgagauguaauuucaguggcacuacugggcaacuccucucucugucccauuaguggaugggcuaucuacagcaaggacaauggcauaagaauugguuccaagggagauguauuugucauaagagagccguucauuucauguucccacuuggaaugccgaacauuuuuccugacucaaggagccuuguuaaaugacaaacacucaaauggaaccguuaaagacagaagccccuacagaaccuuaaugagcuguccuguuggugaggcucccucuccauacaauucaagauuugagucgguugcuuggucagcaagugcuugccaugauggcaucagcugguugacagugggaauuuccgggccagacaauggggcaguugcgguauugaaauacaauggcauaauaacagacaccgucaaaagcuggagaaacaacauauugaggacacaagaaucugaaugugccugcauaaauggcucuugcuuuacuauaaugaccgauggaccaaguaaugggcaggccucguacaagauuuucaagauagaaaaagggaaaguggucaaaucggucgaguugaaugcccccaauuaccacuacgaggaauguucuuguuauccugaugcuagcgaaauaaugugugugugcagggauaauuggcaugguucaaaucgaccgugggugucuuucaaucgaaaucuggaguaucaaauaggguacauauguagugggguuuuuggagacaacccacgccccaaugauggaacaggcagcuguggcccagugucuucuaauggagccuacggggugaaaggauucucguuuaaguacggcaaagguguuuggauagggagaacuaagagcacuaguuccaggaguggauuugaaaugauuugggauccgaauggauggacagagacagauaguaguuucucaguaaagcaagacauuguagcaauaacugauuggucaggauauagugggaguuuuguucaacacccagaauuaacagggcuggacugcauaaggccuugcuuuuggguugaauuaauaagaggacggccuaaggagaauacaauuuggacuagugggagcagcauuuccuucugugguguaaauagcgacacuguggguuggucuuggccagacggugcugaguugccauucaccauugacaaguag

SEQ ID NO: 56694 - RNA, 1410 nt, Artificial Sequence
  neuraminidase__InfluenzaA__BAM85834
augaauccaaaccagaaaauaauaacaauuggcuccgucucucuaacuguugcaacaguguguuuccucaugcagauugccauccuaacaacaaccgugacacugcauuucaagcaaaaugagugcagcauccccgcgaacaaccaagucaugccaugugagccaaucguaauagagaggaacauaacagagauaguguauuugaauaauacuacuauagaaaaagagauuugucuuaaagcggcagaauacaggaauuggucaaaaccgcaaugucaaauuacaggguuugccccguucuccaaggacaacucaauucggcuuucugcugguggggacauuuggguaacgagagaaccuuaugugucaugcgacccaaguaaauguuaucaauuugcacuugggcaggggaccacgcuggaaaacaaacacucaaauggcacaauacaugauaggaucccucaucggacucuuuugaugaaugaguuggguguuccguuucauuugggaaccaaacaagugugcauagcaugguccagcucaaguugucaugaugggaaagcaugguugcauguuugugucacuggggaugauagaaaugcaacugcuaguuucauuuaugaugggaugcuuguugacaguaucgguuccuggucucaaaauauccucagaacucaagagucagaaugcguuugcaucaaugggacuugugcaguaguaaugacugauggaagcgcaucagggagggcagacacuagaauacuauucauuagagaggggaaaauuguccacauuaguccauugucaggaagugcucagcauauagaggaauguuccuguuauccucgauacccuauuaucagaugugucugcagagacaacuggaaaggaucuaauaggcccguuauagauauaaacauggcagauuauagcauugacuccaguuauguguguucaggacuugucggagacacaccaaggaacgaugauagcucuagcagcagcaacugcagggacccuaauaaugagagagggaauccaggaguaaaagggugggccuuugacaaugggaaugauguuuggaugggaagaacaaucaguaaggauucgcguucaggcuaugagacuuucagggucauugguggcugggccacugcuaauuccaagucacagaccaauagacaagucauaguugacaauaacaauuggucugguuauucugggauuuucucuguugaaagcaaaagcugcaucaauagguguuuuuauguggaguuaauaagagggaggccacaggagaccagaguaugguggaccucaaacaguauugucguauucuguggcacuucagggaccuauggaacaggcucauggccugauggggcgaauaucaauuucaugccuauauaa

SEQ ID NO: 56695 - RNA, 1410 nt, Artificial Sequence
  neuraminidase__InfluenzaA__BAM85835
augaauccaaaucagaagauaauaacaauuggcuccgucucucuaaccauugcaacaguauguuuccucaugcagauugccauccuagcaacgacugugacacugcauuucaagcaaaaugaaugcagcauccccgcgaacaaucaaguagugccaugugaaccaauuauaauagagaggaacauaacagagauaguauauuugaauaauacuaccauagagaaagagaucuguucgaaagcaguagacuacaggaauuggucaaaaccgcaaugucaaauuacaggauuugcuccuuuuuccaaggacaacucaauucgacuuucugcugguggggacauuuggguaacaagagagccuuaugugucaugugacaccaguaaauguuaccaauuugcacuugggcaggggaccacacuggacaacaaacauucaaaugggacaauacaugauagaaucccccaucggacccuuuugaugaaugagcuggguguuccguuucacuugggaaccaaacaaguuugcauagcaugguccagcucaaguugccaugaugggaaagcaugguugcauguuugugucacuggggaugauagaaaugcgacugcuaguuucauuuauaauggaaugcuuguugacaguauugguucauggucucaaaauauccucagaacucaggagucagagugcguuugcaucaaugggucuuguacaguaguaaugacugauggaagugcaucagggaaggccgacacuagaauauuauucgucaaagagggaaaaauuauucacauuagcccauugucaggaagugcucagcauauagaggaauguuccuguuauccccgauacccaaacgucagaugugucugcagggacaacuggaggggcucuaauaggccuguuauagauauaaauauggcagauuauagcaucgauuccaguuaugugugcucaggacuuguuggagacacaccaaggaacgaugauaauucuagcagcagcaacugcagggauccuaauaacgagaggggaaacccaggagugaaagggugggccuuugacaguggagaugauguuuggaugggaagaacaaucaguagagauucgcgaucaggcuaugagaccuuuaaggucauuggugguugggccacugcaaauuccaagucacagaccaguagacaagucauaguugacaauaacaacuggucugguuauucugguguuuucucuguugaacacaaaagcugcaucaauagguguuuuuauguggaguugauaagaggaaggccgcaagagacuagaguaugguggaccucaaacaguauugucguauuuuguggcacuucaggcacuuauggaacaggcucauggccugauggggcgaauaucaauuucaugccuauauaa

SEQ ID NO: 56696 - RNA, 1410 nt, Artificial Sequence
  neuraminidase__InfluenzaA__BAM85836
augaauccaaaucagaagauaauaacaauuggcucuguuucucuaaccauugcaacaauauguuuccucaugcaaauugccauccuagcaacgacuguaacacugcauuucaagcagaauggauguaguauccccucaaacaaucaaguagugccaugugaaccaaucauaguagaaaggaacauaacagaaauaguguauuugaauaauacuacaauagaaaaagagcuuuguccuaaaguauuagaauacagggauuggucgaaaccacagugucagauuacaggauucgcuccuuucuccaaggacaacucaauccggcuuucugcugguggggacauuuggguaacaagagagccauaugugucaugcagccccgauaaauguuaucaauucgcacuugggcagggaaccacguuggacaacagacacucaaauggcacaauacaugauagaauuccucaucgaacucuucugaugaacgaauugggugucccguuucacuugggaaccaaacaagugugcauagcauggucuaguucaagcugccaugacggaagggcuugguuacauguuugugucacuggggaugauagaaaugcaacugcuagcuucauuuaugacgggaugcuuguugacaguauuggcucauggucucaaaacauccucagaacucaggagucagaaugcgucugcaucaauggaacuuguacaguaguaaugacugauggaagugcaucaggaagggcugauacuagaauauuauucguuaaagaggggaaaaucgugcauaucagcccacuaucaggaagugcccagcauauagaggaauguuccuguuauccccgcuauccagacguuagauguguuugcagagacaauuggaaaggcucuaauaggcccauuauagauauaaauauggcagauuauagcauugguucuaguuaugugugcucagggcuuguuggcgacacaccgagaaacgaugauagcucuagcaacagcaauugcagggacccuaauaaugagagaggaaacccaggagugaaaggaugggcuuuugacuauggaaaugauguuuggaugggaagaacaaucagcaaggauucacgcucagguuaugagacuuucagggucauuggugguuggacuacggcuaauuccaaaucccaggugaauagacaagucauaguugacaauaguaacuggucugguuauucuggcauuuucucuguugaaggcaaaagcugcauuaauagguguuuuuauguggaauugauaagagggaggccacaagagacuagaguaugguggaccucaaauaguauugucguguuuuguggcacuucagguaccuauggaacaggcucauggccugauggggcgaauaucaauuucaugccuauauaa

SEQ ID NO: 56697 - RNA, 1410 nt, Artificial Sequence
  neuraminidase__InfluenzaA__BAO79717
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcacccuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuccaucugggaaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaaacugcaucaaucggugcuuuuauguggaguugauuaggggaagaaaagaggaaacugaagucuuguggaccucaaacaguauuguuguguuuuguggcaccucagguacauauggaacaggcucauggccugauggggcugaccucaaucucaugccuauauaa

SEQ ID NO: 56698 - RNA, 1413 nt, Artificial Sequence
  neuraminidase__InfluenzaA__CAA33354
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuacuuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 56699 - RNA, 1404 nt, Artificial Sequence
  Neuraminidase__InfluenzaA__CAB95858
augaauccaaaucaaaagauaauagcacuuggcucuguuucuauaacuauugcgacaauauguuuacucaugcagauugccaucuuagcaacgacuaugacacuacauuucaacgaaugcaccaacccaucgaacaaucaagcaaugccaugugaaccaaucauaauagaaaggaacauaacagagauagugcauuugaauaauacuaccauagagaaggaaaguuguccuaaaguagcagaauacaagaauuggucaaaaccgcaaugucaaauuacaggguucgccccuuucuccaaggacaacucaauuaggcuuucugcaggcggggauauuugggugacaagagaaccuuauguaucgugcggucuugguaacuguuaccaauuugcacuugggcagggaaccacuuugaacaacaaacacucaaauggcacaauacaugauaggaguccccauagaacccuuuuaaugaacgaguuggguguuccauuucauuugggaaccaaacaagugugcauagcaugguccagcucaagcugccaugaugggaaagcaugguuacauguuugugucacuggggaugauagaaaugcgacugcuagcaucauuuaugaugggaugcuuaccgacaguauugguucauggucuaagaacauccucagaacucaggagucagaauguguuugcaucaauggaacuuguacaguaguaaugacugauggaagugcaucaggaagggcugauacuaaaauacuauucauuagagaagggaaaauuguccacauuaguccacugucaggaagugcucaacauguggaggaaugcuccuguuacccccgguauccagaaguuagauguguuugcagagacaauuggaagggcuccaauagacccgugcuauauauaaauguggcagauuauaguguugauucuaguuaugugugcucaggacuuguuggcgacacaccaagaaaugacgauagcuccagcagcaguaacugcagggaucccaauaacgagagagggggcccaggagugaaagggugggccuuugacaauggaaaugauguuuggaugggacgaacaaucaagaaagauucgcgcucugguuaugagacuuucagggucguuggugguuggacuacggcuaauuccaagucacaaauaaauaggcaagucauaguugacagugauaacuggucuggguauucugguauauucucuguugaaggaaaaaccugcaucaacagguguuuuuauguggaguugauaagagggagaccacaggagaccagaguaugguggacuucaaauagcaucauuguauuuuguggaacuucagguaccuauggaacaggcucauggccugauggagcgaauaucaauuucaugucuauauaa

SEQ ID NO: 56700 - RNA, 1404 nt, Artificial Sequence
  neuraminidase__InfluenzaA__CAB95859
augaauccaaaucaaaagauaauagcacuuggcucuguuucuauaacuauugcgacaauauguuuacucaugcagauugccaucuuagcaacgacuaugacacuacauuucaaugaauguaccaacccaucgaacaaucaagcagugccaugugaaccaaucauaauagaaaggaacauaacagagauagugcauuugaauaauacuaccauagagaaggaaaguuguccuaaaguagcagaauacaagaauuggucaaaaccgcaaugucaaauuacaggguucgccccuuucuccaaggacaacucaauuaggcuuucugcaggcggggauauuugggugacaagagaaccuuauguaucgugcggucuugguaaauguuaccaauuugcacuugggcagggaaccacuuugaacaacaaacacucaaauggcacaauacaugauaggaguccccauagaacccuuuuaaugaacgaguuggguguuccauuucauuugggaaccaaacaagugugcauagcaugguccagcucaagcugccaugaugggaaggcaugguuacauguuugugucacuggggaugauagaaaugcgacugcuagcaucauuuaugaugggaugcuuaccgacaguauugguucauggucuaagaacauccucagaacucaggagucagaaugcguuugcaucaauggaacuuguacaguaguaaugacugauggaagugcaucaggaagggcugauacuaaaauacuauucauuagagaagggaaaauuguccacauugguccacugucaggaagugcucagcauguggaggaaugcuccuguuacccccgguauccagaaguuagauguguuugcagagacaauuggaagggcuccaauagacccgugcuauauauaaauguggcagauuauaguguugauucuaguuaugugugcucaggacuuguuggcgacacaccaagaaaugacgauagcuccagcagcaguaacugcagggauccuaauaacgagagagggggcccaggagugaaagggugggccuuugacaauggaaaugauguuuggaugggacgaacaaucaagaaagauucgcgcucugguuaugagacuuucagggucguuggugguuggacuacggcuaauuccaagucacaaauaaauaggcaagucauaguugacagugauaacuggucuggguauucugguauauucucuguugaaggaaaaaccugcaucaacagguguuuuuauguggaguugauaagagggagaccacaggagaccagaguaugguggacuucaaauagcaucauuguauuuuguggaacuucagguaccuauggaacaggcucauggccugauggagcgaauaucaauuucaugucuauauaa

SEQ ID NO: 56701 - RNA, 1410 nt, Artificial Sequence; identical to SEQ ID NO: 47217
  Neuraminidase__InfluenzaA__CAC19707

SEQ ID NO: 56702 - RNA, 1410 nt, Artificial Sequence
  neuraminidase__InfluenzaA__CAD29959
augaauccaaaucaaaagauaauaacgauuggcucuguuucucucaccauugccacaauaugcuuccuuaugcaaauugccauccuuguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugcuugaauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 56703 - RNA, 1410 nt, Artificial Sequence
  neuraminidase__InfluenzaA__CAD29960
augaauccaaaucaaaagauaauaacgauuggcucuguuucucucacuauugccacaauaugcuuccuuaugcaaauugccauccugguaacuacuguaacauugcauuucaagcaauaugaaugcaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacauguuaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuacccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 56704 - RNA, 1410 nt, Artificial Sequence
  neuraminidase__InfluenzaA__CAD29961
augaauccaaaucaaaagauaauaacgauuggcucuguuucucucaccauuuccacaauaugcuucuuuaugcaaauugccauccugguaacuacuguaacauugcauuucaagcaauaugaaugcaacucccccccaaacaaccaagugaugcugugugaaccaacaauaauagaaagaaacacaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggaccuuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucagggccugauggggcggacaucaaucucaugccuauauaa

SEQ ID NO: 56705 - RNA, 1410 nt, Artificial Sequence
  neuraminidase__InfluenzaA__CAD29962
augaauccaaaucaaaagauaauaacgauuggcucuguuucucucaccauuuccacaauaugcuucuuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 56706 - RNA, 1410 nt, Artificial Sequence; identical to SEQ ID NO: 44788
  neuraminidase__InfluenzaA__CAD29963

SEQ ID NO: 56707 - RNA, 1410 nt, Artificial Sequence
  neuraminidase__InfluenzaA__CAD29964
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguauuugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagggaaccuuaugugucgugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 56708 - RNA, 1410 nt, Artificial Sequence; identical to SEQ ID NO: 46975
  neuraminidase__InfluenzaA__CAD29965

SEQ ID NO: 56709 - RNA, 1410 nt, Artificial Sequence
  neuraminidase__InfluenzaA__CAD29966
augaauccaaaucaaaagauaauaacgauuggcucuguuucucucacuauugccacaauaugcuuccuuaugcaaauagcuauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauacuaguaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 56710 - RNA, 1410 nt, Artificial Sequence; identical to SEQ ID NO: 44563
  neuraminidase__InfluenzaA__CAD29967

SEQ ID NO: 56711 - RNA, 1410 nt, Artificial Sequence
  neuraminidase__InfluenzaA__CAD29968
augaauccaaaucaaaagauaauaacgauuggcucuguuucucucacuauugccacaauaugcuuccuuaugcaaauugccauccugguaacuacugugacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucaugauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuaaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 56712 - RNA, 1410 nt, Artificial Sequence; identical to SEQ ID NO: 47217
  neuraminidase__InfluenzaA__CAD29969

SEQ ID NO: 56713 - RNA, 1410 nt, Artificial Sequence
  neuraminidase__InfluenzaA__CAD29970
augaauccaaaucaaaagauaauaacuauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggagugcguuuguaucaauggaacuuguacaguaguaaugacugaugggagugcuucaggaagagcugauacuaaaauacuauucauugaggaggggaaaaucguucauauuagcccauugucaggaagugcucagcaugucgaggagugcuccuguuauccucgauauccugguaucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 56714 - RNA, 1410 nt, Artificial Sequence
  neuraminidase__InfluenzaA__CAD29971
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucaucuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauuaucagggagugcucagcaugucgaggagugcuccuguuauccucgauauccuggugucagaugugucugcagagacaacuggaaaggcuccaauaggcccaucguagacauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 56715 - RNA, 1410 nt, Artificial Sequence
  neuraminidase__InfluenzaA__CAD29972
augaauccaaaucaaaagauaauaacgauuggcucuguuucucucaccauugccacaauaugcuuccuuaugcaaauugucauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuccauuugggaaccaagcaagugugcauagcaugguccagcucaaguugucacgauggaaaagcauggcugcauguuuguguaacgggggaugauaaaaaugcaacugcuaguuucauuuacaaugggaggcuuguagauaguauagguucaugguccaaaaaaauccucaggacccaggagucggaaugcguuuguaucaauggaacuugugcaguaguaaugacugaugggagugcuucaggaaaagcugauacuaaaauacuauucauugaggaggggaaaaucggucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaccaggaaacugaaaucuuguggaccucaaacaguauuguuguguuuuguggcaccucagguacauauggaacaggcucauggccugauggggcggacaucaaucucaugccuauauaa

SEQ ID NO: 56716 - RNA, 1410 nt, Artificial Sequence
  neuraminidase__InfluenzaA__CAD29973
augaauccaaaucaaaagauaauaacuauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauucuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 56717 - RNA, 1410 nt, Artificial Sequence
  neuraminidase__InfluenzaA__CAD29974
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccgaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 56718 - RNA, 1410 nt, Artificial Sequence
  neuraminidase__InfluenzaA__CAD29984
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaacauuaugugucaugcgaucgugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucaccauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauuaaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaagcuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 56719 - RNA, 1410 nt, Artificial Sequence
  neuraminidase__InfluenzaA__CAD29985
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugggggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaguuggguguuccauuucauuugggaaccaagcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucaggacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauugcagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucacguacauauggaacaggcucauggccugauggggcggauaucaaucucaugccuauauaa

SEQ ID NO: 56720 - RNA, 1410 nt, Artificial Sequence
  neuraminidase__InfluenzaA__CAD29988
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaccugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagugcuucagaaaaagcugauacuaaaauacuauucauugaggaggggaaaaucguucauaucagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccaggaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 56721 - RNA, 1410 nt, Artificial Sequence
  neuraminidase__InfluenzaA__CAD29990
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugguaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacaacuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 56722 - RNA, 1410 nt, Artificial Sequence
  neuraminidase__InfluenzaA__CAD29991
augaauccaaaucaaaagauaauaacgauuggcucuguuucccucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcgucaggaaaagcugauacuaaaauacuauucaucgaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 56723 - RNA, 1410 nt, Artificial Sequence
  neuraminidase__InfluenzaA__CAD29992
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggaucguagcauugucuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 56724 - RNA, 1410 nt, Artificial Sequence
  neuraminidase__InfluenzaA__CAD29993
augaauccaaaucaaaagauaauaacgauuggcucuguuucucucaccauugccacaacaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 56725 - RNA, 1410 nt, Artificial Sequence; identical to SEQ ID NO: 52465
  neuraminidase__InfluenzaA__CAD29994

SEQ ID NO: 56726 - RNA, 1413 nt, Artificial Sequence; identical to SEQ ID NO: 46957
  neuraminidase__InfluenzaA__CAD57252

SEQ ID NO: 56727 - RNA, 1413 nt, Artificial Sequence
  neuraminidase__InfluenzaA__CAD57253
augaauccaaaucaaaaaauaauaaccauuggaucaaucaggauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagauuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 56728 - RNA, 1413 nt, Artificial Sequence
  neuraminidase__InfluenzaA__CAD57255
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucggugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggggcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgcuucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 56729 - RNA, 1413 nt, Artificial Sequence
  neuraminidase__InfluenzaA__CAD57256
augaauccaaaucaaaaaauaauaaccauuggaucaaucaguguggcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccgucuccauauaauucaaaguuugaaucaguugcuuggucagcaagcgcaugccaugauggcaugggcugguuaacaaucggaauuuccgguccagacaauggagcuguggcuguacuaaaauacaacggcauaauaacugaaaccauaaaaaguuggaaaaagcgaauauuaagaacacaagagucugaaugugucugugugaacgggucauguuuuaccauaaugaccgauggcccgaguaauggggccgcaucguacagaaucuucaaaaucgagaaggggagaguuacuaaaucaauagaguuggaugcacccaauuaucauuacgaggaauguuccuguuacccagacaccggcacagugaugugugugugcagggacaacuggcacgguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggguuggacuguauaagaccuugcuucuggguugaguuagucagaggacggccuagagaaaauacaacaaucuggacuagugggagcagcauuucuuuuuguggcguaaauagugauacugcaaacuggucuuggccagacggugcugaguugccauucaccauugacaaguag

SEQ ID NO: 56730 - RNA, 1413 nt, Artificial Sequence
  neuraminidase__InfluenzaA__CAD57257
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaauagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaaacauucaaaugggaccguuaaggacagaaguccuuauagggccuuaaugagcuguccucuaggcgaagcuccgucuccauauaauucaaaguuugaaucaguugcuuggucagcaagcgcaugccaugauggcaugggcugguuaacaaucggaauuucugguccagauaauggagcaguggcuguacuaaaauacaacggcauaauaacugaaaccauaaaaaguuggaaaaagcgaauauuaagaacacaagagucugaaugugucugugugaacgggucauguuuuaccauaaugaccgauggcccgaguaauggggccgccucguacaaaaucuucaagaucgagaaggggaagguuacuaaaucaauagaguugaaugcacccaauucucauuaugaggaauguuccuguuacccagacacuggcacagugauguguguaugcagggacaauuggcacgguucaaaucgaccuugggugucuuuuaaucaaaaccuggauuaucaaauaggauacaucugcagugggguguuuggugacaauccgcgucccaaagauggagagggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauguuguggcaaugacugauuggucaggguacagcggaaguuucguucaacauccugagcuaacaggauuggacuguauaagaccuugcuucuggguugaauuagucagaggacggccuagagaaaauacaacaaucuggacuagugggagcagcauuucuuuuuguggcguaaauagugauacugcaaacuggucuuggccagacggugcugaguugccauucaccauugacaaguag

SEQ ID NO: 56731 - RNA, 1413 nt, Artificial Sequence
  neuraminidase__InfluenzaA__CAD57258
augaauccaaaucaaaaaauaauaaccauuggaucaaucaguguggcaaucggaauaauuagucuaauauugcaaauaggaaauauuauuucaauaugggcuagccacucaauccaaacuggaagucaaaacuacacuggaauaugcaaccaaagaaucauuacauaugaaaauagcaccuggguaaaucaaacauauguuaauauuaacaacacuaauguuguugcuggaaaggacaaaaccucaaugguauuggccggcaauucaucucuuugcccuauccguggaugggcuauauacacaaaagacaacagcauaagaauugguuccaaaggagauauuuuugucauaagagagccuuuuauaucauguucucauuuggaaugcagaaccuuuuuucugacccaaggugcucuauuaaaugacaagcauucaaaugggaccguuaaggacagaagcccuuauagggccuuaaugagcuguccucugggugaagcuccgucuccauacaauucaagauuugaaucaguugcuuggucagcaagcgcaugccaugauggcuugggcuggcuaacaaucggaauuucugguccagauaauggagcaguggcuguacuaaaauacaacggcauaauaacugaaaccauaaaaaguuggaagaagcaaaucuuaagaacacaagagucugaaugugucugugugaacgguucauguuuuaccauaaugaccgauggcccgaguaauagggccgcaucguacagaaucuucaaaaucgagaaggggagaguuacuaaaucaauagaguuggaugcacccaauuaucauuacgaagaauguuccuguuacccagacaccggcacaguaaugugugugugcagggacaauuggcacgguucaaaucgaccuugggugucuuuuaaucaaaaccuugauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggcuuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgaaacugcaaacuggucuuggccagacggugcugaguugccauucaccauugacaaguag

SEQ ID NO: 56732 - RNA, 1413 nt, Artificial Sequence
  neuraminidase__InfluenzaA__CAD57259
augaauccaaaucaaaaaauaauaaccauuggaucaaucaguauugcaauuggaauaauuagucugauauugcaaauaggaaauauuauuucaauaugggcuagccacucaauccaaacugaaagucaaaaccacacuggaauaugcaaccaaagaaucauuacauaugaaaauagcaccugggugaaucaaacauauguuaauauuaacaacacuaauguugcugcuggaaaggacaaaaccucaaugacauuggccggcaauucaucucuuugcccuauccguggaugggcuauauacacaaaagacaacagcauaagaauugguuccaaaggagauauuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaaucucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagaaaccggcacagugaugugugugugcagggacaauuggcacgguucaaaucgaccuugggugucuuuuaaucaaaaccuggauuaucaaauaggauacaucugcagugggguguuuggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaagauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaauuggucuuggccagacggugccgaguugccauucaccauugacaaguag

SEQ ID NO: 56733 - RNA, 1413 nt, Artificial Sequence
  neuraminidase__InfluenzaA__CAD57264
augaauccaaaucaaaaaauaauaaccauuggaucaaucaguguggcaaucggaauaauuagucuaauauugcaaauaggaaauauuauuucaauaugggcuagccacucaauccaaacuggaagucaaaacuacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucugggugaagcuccgucuccauacaauucaagauuugaaucaguugcuuggucagcaagcgcaugccaugauggcuugggcuggcuaacaaucggaauuucugguccagauaauggagcaguggcuguacuaaaauacaacgguauaauaacugaaaccauaaaaaguuggaagaagcaaaucuuaagaacacaagagucugaaugugucugugugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguuccuguuacccagacaccggcacagugaugugugugugcagggacaauuggcaugguucaaaucgaccuugggugucuuuuaaucaaaaccuggauuaucaaauaggauacaucugcagugggguguucggugacaauccgcgucccaaagauggagaaggcagcuguaauccagugacuguugauggagcaaacggaguaaagggguuuucauacagauaugguaaugguguuuggauaggaaggacuaaaaguaacagacucagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgagacugcaaauuggucuuggccagacggugcugaguugccauucaccauugacaaguag

SEQ ID NO: 56734 - RNA, 1350 nt, Artificial Sequence
  neuraminidase__InfluenzaA__CBW54819
augaauccaaaucagaagauaauaaccaucggaucaaucuguaugguaauuggaauaguuagcuuaauguuacagauugggaacaugaucucaauaugggucagucauucaauucagacggggaaucagugccaagcugaaccgaucagcaauacuaaauuucuuacugagaaagcuguagcuucaguaacauuagcgggcaauucaucucuuugucccauuagcggaugggcuguauacaguaaggacaacaguauaaggaucgguuccaggggggauguguuuguuauaagagagccauucaucucaugcucccacuuggaaugcaggacuuucuuuuugacucagggagccuugcuaaaugacaagcacuccaaugggacugucaaagacagaagcccucacagaacauuaaugaguuguccugugggugaggcucccuccccauauaacucaagguuugagucuguugcuuggucagcuagugcuugccaugauggcaucaguugguugacaauuggaauuucugguccagacaauggggcuguggcuguauugaaauacaauggcauaauaacagacaccaucaagaguuggaggaacaacauacuaagaacucaagaaucugaaugugcauguguaaauggcucuugcuuuacuguaaugacugacggaccaaguagugggcaggcaucauauaagaucuucaaaauggaaaaagggaaagugguuaaaucagucgaauuggaugcuccuaauuaucacuaugaggagugcuccuguuauccugaugccggugaaaucacauguguguguagggauaauuggcauggcucaaauagaccauggguaucuuucaaucaaaaucuggaguaucgaauaggauauauaugcaguggaguuuucggagacaauccacgccccaacgauggaacagguaguugugguccgguguccccuaacggggcauaugggguaaaaggguuuucauuuaaauacggcgaugguguuuggaucgggaggaccaaaagcacuaauuccaggagcggcuuugaaaugguuugggacccaaauggguggacuggaacggacaguagcuuuucggugaagcaagauaucguagcaauaaccgauuggucaggauauagugggaguuuuguccagcauccagaacugacaggauuagauuguauaagaccuuguuucuggguugaguuaaucagagggcggccuaaagagagcacaauuuggaccaguggaagcagcauauccuuuugugguguaaauagugacacuguuaguuggucuuggccagacggugcugaguugccauucaccauugacaaguag

SEQ ID NO: 56735 - RNA, 1350 nt, Artificial Sequence
  neuraminidase__InfluenzaA__CBW54821
augaauccaaaucagaagauaauaaccaucggaucaaucuguauaguaauuggaauaguuagcuuaauguuacagauugggaacaugaucucaauaugggucagucauucaauucagacagggaaucagugccaagcugaaccgaucagcaauacuaaauuucuuacugagaaagcuguagcuucaguaacauuagcgggcaauucaucucuuugucccauuagcggaugggcuguauacaguaaggacaacaguauaaggaucgguuccaggggggauguguuuguuauaagagagccauucaucucaugcucccacuuggaaugcagaacuuucuuuuugacucagggagccuugcuaaaugacaagcacuccaaugggacugucaaagacagaagcccucacagaacauuaaugaguuguccugugggugaggcucccuccccauauaacucaagguuugagucuguugcuuggucagcuagugcuugccaugauggcaucaguugguugacaauuggaauuucugguccagacaauggggcuguggcuguauugaaauacaauggcauaauaacagacaccaucaagaguuggaggaacaacauacuaagaacucaagaaucugaaugugcauguauaaauggcucuugcuuuacuguaaugacugacggaccaaguagugggcaggcaucauauaagaucuucaaaauggaaaaagggaaagugguuaaaucagucgaacuagaugcuccuaauuaucacuaugaggagugcuccuguuauccugaugccggcgaaaucacauguguguguagggauaauuggcauggcucaaauaggccauggguaucuuucaaucaaaaucuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggaggaccaaaagcacuaauuccaggagcggcuuugaaaugauuugggacccaaauggguggacuggaacggacaguagcuuuucagugaagcaagauaucguagcaauaacugauuggucaggauauagugggaguuuuguccagcauccagaacugacaggauuagauugcauaagaccuuguuucuggguugaguuaaucagagggcagccuaaagagagcacaauuuggaccaguggaagcagcauauccuuuugugguguaaauagugacacuguuaguuggucuuggccagacggugcugaguugccauucaccauugacaaguag

SEQ ID NO: 56736 - RNA, 1410 nt, Artificial Sequence
  neuraminidase__InfluenzaA__CCG47912
augaauccaaaucaaaagauaauaacaauugguucuguuucucucacuauugcaacaaugugccucuucaugcagauugccauccuaauaacuacuguaacauugcauuucaagcaauaugaaugcgauuccccugcaaacaaccaaguaaugccgugugaaccaauaauaauagaaaaaaacauaacaaaaauaguguauuugacuaacaccaccauagagaaagagguaugcccaaaauuaggggaauacaggaauuggucaaaaccacaaugcagaaucacaggauuugcaccuuuuuccaaggacaauucaauucggcuuucugcagguggggccauuugggucacgagagaaccuuaugugucaugcgauccuaacaaauguuaucaauuugcauuaggacagggaaccacacuggacaacagacauucaaaugacacaauacaugauagaaccccuuauagaacccuguugaugaaugaguuggguguuccauuucauuugggaaccagacaaguauguauagcaugguccagcucaaguugucacgauggaaaagcauggcugcauguuugugucacugggcaugauaaaaaugcaacugcuaguuucauuuaugacggaaagcuuguagacaguauuaguucauggucucaaaacauacuccggacucaggaaucagaguguguuuguaucaauggaaucugcacaguagugaugacugauggaagugcuucagggaaagcugacaccaaaauacuauucauugaagaagggaaggucauucauauuaguccauuguugggaagugcucagcauguggaagaauguuccuguuacccucgauacccugaugucagguguauuugcagggacaacuggaaagguucaaauaggcccaucguagacauaagaaugaaagauuauagcauugguuccaguuauaugugcucagggcuuguuggcgacacacccagaaacaaugaugggucuaguaauagcaauugccgaaauccuaacaaugagagagggaaucauggggugaaaggcugggccuuugaugauggaaaugacauauggaugggaagaacuaucagcaaggacucacgcuuagguuacgaaaccuuuaagguuguuggugguuggucccaacccaauuccaaauuccagauaaauaggcaagucauuguugacagcgauaauagaucagguuauucugguauuuucucuguugaggggaaaaguugcaucaauaggugcuuuuauguggagcuaauaagaggaaggaggcaggaaacuagaguaugguggacuucgaacaguauuguuguguucuguggcacuucaggcacuuaugggucaggcucauggccugauggggcagacaucaauuucaugccuauauaa

SEQ ID NO: 56737 - RNA, 1353 nt, Artificial Sequence
  neuraminidase_subtype_1__InfluenzaA__AAF74321
augaauccaaaucagaagauaauaaccauuggaucaaucuguaugguaguugggauaaucagcuugauguuacaaauuggaaacauaauaucaguaugggucagccacacaauucaaacuuggcacccaaaccagccugaaccaugcaaucaaagcaucaauuuuuacacugagcaggcugcagcuucagugacauuagcgggcaauuccucucucugcccuauuaguggaugggcuauauacagcaaggacaauaguauaagaauugguuccaaaggggauguguuuguuauaagagaaccauucaucucaugcucccauuuggaaugcagaaccuuuuucuugacccaaggagcccuauugaaugacaagcauucuaaugggaccgucaaagacaggagccccuauagaacuuuaaugagcuguccuguuggugaggcuccuuccccauacaacucaagguuugagucuguugcuuggucggcaagugcuugccaugauggcauuaguuggcuaacaauuggaauuuccgguccggauaauggggcuguggcuguguugaaauacaauggcauaauaacagacaccaucaagaguuggaggaacaacauacugaggacgcaagagucugaaugugcaugugugaaugguucuuguuuuacuguaaugacagauggaccgaguaaugaacaggccucauacaagauuuucaagauagaaaaggggaggguagucaaaucaguugaguugaacgccccuaauuaucauuaccaggaaugcuccuguuacccugaugcuggcgaaaucacaugugugugcagggauaauuggcauggcucgaaccgaccaugggugucuuucaaucagaaucuggaguaccaaauaggauauauaugcagugggguuuucggagacaguccacgccccaaugaugggacaggcaguugugguccagugucucuuaacggagcguauggaguaaaaggguuuucauuuaaauacggcaaugguguuuggaucgggagaaccaaaagcacuaguuccaggagcgguuuugaaaugauuugggauccaaauggguggaccgaaacagacaguagcuucucguugaagcaagacaucauagcaauaacugauuggucaggauacagcgggaguuuuauucaacauccagaacugacaggauuaaauugcaugagaccuugcuucuggguugaacuaaucagagggaggcccaaagagaaaacaaucuggacuagugggagcaguauaucuuucugugguguaaauagugacacuguggguuggucuuggccagacggugcugaguugccauucaccauugacaaguag

SEQ ID NO: 56738 - RNA, 1353 nt, Artificial Sequence
  neuraminidase_subtype_1__InfluenzaA__AAF74322
augaauccaaaucagaagauaauaaccauuggaucaaucugcaugguaguugggauaaucagcuugauguuacaaauuggaaacacaauaucaguaugggucagccacauaauuaaaacuuggcacccaaaccagccugaaccaugcaaucaaagcaucaauuuuuacacugagcaggcugcagcuucagugacauuagcgggcaauuccucucucugcccuauuaguggaugggcuauauacagcaaggacaauaguauaagaauugguuccaaaggggauguguuuguuauaagagaaccauucaucucaugcucccauuuggaaugcagaaccuuuuucuugacccaaggagcccuauugaaugacaagcauucuaaugggaccgucaaagacaggagccccuauagaacuuuaaugagcuguccuguuggugaggccccuuccccauacaacucaagguuugagucuguugcuuggucagcaagugcuugccaugauggcauuaguuggcuaacaauuggaauuuccgguccggauaauggggcuguggcuguguugaaauacaauggcauaauaacagacaccaucaagaguuggaggaacaacacacugaggacgcaagagucugaaugugcaugugugaaugguucuuguuuuacuguaaugacagauggaccgaguaaugaacaggccucauacaagauuuucaagauagaaaaggggaggguagucaaaucaguugaguugaacgccccuaauuaucauuacgaggaaugcuccuguuauccugaugcuggcgaaaucacaugugugugcagggauaauuggcauggcucgaaccgaccaugggugucuuucaaucagaaucuggaguaucaaauaggauauauaugcagugggguuuucggagacaguccacgccccaaugaugggacaggcaguugugguccagugucucuuaacggagcguauggaguaaaaggguuuucauuuaaauacggcaaugguguuuggaucgggagaaccaaaagcacuaguuccaggagcgguuuugaaaugauuugggauccaaauggguggaccgaaacagacaguagcuucucguugaagcaagacaucauagcgauaacugauuggucaggauacagcgggaguuuuauucaacauccagaacugacaggauuaaauugcaugagaccuugcuucuggguugaacuaaucagagggaggcccaaagagaaaacaaucuggacuagugggagcaguauaucuuucugugguguaaauagugacacuguggguuggucuuggccagacggugcugaguugccauucaccauugacaaguag

SEQ ID NO: 56739 - RNA, 1353 nt, Artificial Sequence
  neuraminidase_subtype_1__InfluenzaA__AAF74323
augaauccaaaucagaagauaauaaccauugggucaaucuguaugguaguugggauaaucagcuugauguuacaaauuggaaacauaauaucaguauggaucagccacauaauucaaacuuggcauccaaaccagccugaaccaugcaaucaaagcaucaauuuuuacacugagcaggcugcagcuucagugacauuagcgggcaauuccucucucugcccuauuaguggaugggcuauauacagcaaggacaauaguauaagaauugguuccaaaggggauguguuuguuauaagagaaccauucaucucaugcucccauuuggaaugcagaaccuuuuucuugacccaaggagcccuauugaaugacaagcauucuaaugggaccgucaaagacaggagccccuauagaacuuuaaugagcuguccuguuggugaggcuccuuccccauacaacucaagguuugagucuguugcuuggucagcaagugcuugccaugauggcauuaguuggcuaacaauuggaauuuccgguccggauaaugaggcuguggcuguguugaaauacaauggcauaauaacagacaccaucaggaguuggaggaacaacauacugaggacgcaagagucugaaugugcaugugugaaugguucuuguuuuacuguaaugacagauggaccgaguaaugaacaggccucauacaagauuuucaagauagaaaaggggaggguagucaaaucaguugaguugaacgccccuaauuaucauuacgaggaaugcuccuguuauccugaugcuggcgaaaucacaugugugugcagggauaauuggcauggcucgaaccgaccaugggugucuuucaaucagaaucuggaguaucaaauaggauauauaugcagugggguuuucggagacaguccccgccccaaugaugggacaggcaguugugguccagugucucuuaacggagcguauggaguaaaaggguuuucauuuaaguauggcaaugguguuuggaucgggagaaccaaaagcacuaguuccaggagcgguuuugaaaugauuugggauccaaauggguggaccgaaacagacaguagcuucucguugaagcaagacaucauagcaguaacugauuggucaggauacagcgggaguuuuauccaacacccagaacugacaggauuaaauugcaugagaccuugcuucuggguugaacuaaucagagggaggcccaaagagaaaacaaucuggacuagugggagcaguauaucuuucugugguguaaauagugacacuguggguuggucuuggccagacggugcugaguugccauucaccauugacaaguag

SEQ ID NO: 56740 - RNA, 1353 nt, Artificial Sequence
  neuraminidase_subtype_1__InfluenzaA__AAF74324
augaauccaaaucagaagauaauaaccauuggaucaaucuguaugguaguugggauaaucagcuugauguuacaaauuggaaacauaauaucaguaugggucagccacauaauucaaacuuggcauccaaaccagccugaaccaugcaaucaaagcaucaauuuuuacacugagcaggcugcagcuucagugacauuagcgggcaauuccucucucugcccuauuaguggaugggcuauauacagcaaggacaauaguauaagaauugguuccaaaggggauguguuuguuauaagagaaccauucaucucaugcucccauuuggaaugcagaaccuuuuucuugacccaaggagcccuauugaaugacaagcauucuaaugggaccgucaaagacaggagccccuauagaacuuuaaugagcuguccuguuggugaggcuccuuccccauacaacucaagguuugagucuguugcuuggucagcaagugcuugccaugauggcauuaguuggcuaacaauuggaauuuccgguccggauaauggggcuguggcuguguugaaauacaauggcauaauaacagacaccaucaagaguuggaggaacaacauacugaggacgcaagagucugaaugugcaugugugaaugguucuugcuuuacuguaaugacagauggaccgaguaaugaacaggccucauacaagauuuucaagauagaaaaggggaggguagucaaaucaguugaguugaacgccccuaauuaucauuacgaggaaugcuccuguuauccugaugcuggcgaaaucacaugugugugcagggauaauuggcauggcucgaaccgaccaugggugucuuucaaucagaaucuggaguaucaaauaggauauauaugcagugggguuuucggagacaguccacgccccaaugauggaacaggcaguugugguccagugucucuuaacggagcguauggaguaaaaggguuuucauuuaaauacggcaaugguguuuggaucgggagaaccaaaagcacuaguuccaggagcgguuuugaaaugauuugggauccaaauggguggaccgaaacagacaguagcuucucguugaagcaagacaucauagcaauaacugauuggucaggauacagcgggaguuuuauucaacauccagaacugacaggauuaaauugcaugagaccuugcuucuggguugaacuaaucagagggaggcccaaagagaaaacaaucuggacuagugggagcaguguaucuuucugugguguaaauagugacacuauggguuggucuuggccagacggugcugaguugccauucaccauugacaaguag

SEQ ID NO: 56741 - RNA, 1353 nt, Artificial Sequence
  neuraminidase_subtype_1__InfluenzaA__AAF74325
augaauccaaaucagaagauaauaaccauuggaucaaucugcaugguaguugggauaaucagcuugauguuacaaauuggaaacacaauaucaguaugggucagccacauaauuaaaacuuggcacccaaaccagccugaaccaugcaaccaaagcaucaauuuuuacacugagcaggcugcagcuucagugacauuagcgggcaauuccucucucugcccuauuaguggaugggcuauauacagcaaggacaauaguauaagaauugguuccaaaggggauguguuuguuauaagagaaccauucaucucaugcucccauuuggaaugcagaaccuuuuucuugacccaaggagcccuauugaaugacaagcauucuaaugggaccgucaaagacaggagccccuauagaacuuuaaugagcuguccuguuggugaggccccuuccccauacaacucaagguuugagucuguugcuuggucagcaagugcuugccaugauggcauuaguuggcuaacaauuggaauuuccgguccggauaauggggcuguggcuguguugaaauacaauggcauaauaacagacaccaucaagaguuggaggaacaacacacugaggacgcaagagucugaaugugcaugugugaaugguucuuguuuuacuguaaugacagauggaccgaguaaugaacaggccucauacaagauuuucaagauagaaaaggggaggguagucaaaucaguugaguugaacgccccuaauuaucauuacgaggaaugcuccuguuauccugaugcuggcgaaaucacaugugugugcagggauaauuggcauggcucgaaccgaccaugggugucuuucaaucagaaucuggaguaucaaauaggauauauaugcagugggguuuucggagacaguccacgccccaaugaugggacaggcaguugugguccagugucucuuaacggagcguauggaguaaaaggguuuucauuuaaauacggcaaugguguuuggaucgggagaaccaaaagcacuaguuccaggagcgguuuugaaaugauuugggauccaaauggguggaccgaaacagacaguagcuucucguugaagcaagacaucauagcgauaacugauuggucaggauacagcgggaguuuuauucaacauccagaacugacaggauuaaauugcaugagaccuugcuucuggguugaacuaaucagagggaggcccaaagagaaaacaaucuggacuagugggagcaguauaucuuucugugguguaaauagugacacuguggguuggucuuggccagacggugcugaguugccauacaccauugacaaguag

SEQ ID NO: 56742 - RNA, 1410 nt, Artificial Sequence; identical to SEQ ID NO: 47232
  neuraminidase__InfluenzaA__EPI239900

SEQ ID NO: 56743 - RNA, 1410 nt, Artificial Sequence; identical to SEQ ID NO: 47581
  neuraminidase__InfluenzaA__EPI221062

SEQ ID NO: 56744 - RNA, 1410 nt, Artificial Sequence; identical to SEQ ID NO: 47232
  neuraminidase__InfluenzaA__EPI534079

SEQ ID NO: 56745 - RNA, 1410 nt, Artificial Sequence; identical to SEQ ID NO: 47232
  neuraminidase__InfluenzaA__AGM53851

SEQ ID NO: 56746 - RNA, 1410 nt, Artificial Sequence
  neuraminidase__InfluenzaA__EPI731464
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuggcgggcgguuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56747 - RNA, 1410 nt, Artificial Sequence; identical to SEQ ID NO: 47232
  neuraminidase__InfluenzaA__EPI696973

SEQ ID NO: 56748 - RNA, 1410 nt, Artificial Sequence
  neuraminidase__InfluenzaA__EPI662593
augaauccaaaccaaaagauaauaaccauugguucgaucuguaugacaauuggaauggcuaacuuaauauuacaaauuggaaacauaaucucaauauggguuagccacucaauucaaauuggaaaucaaagccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaccgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaaaaucuucagaauagaaaagggaaagauaaucaaaucagucgaaaugaaagccccuaauuaucacuaugaggaaugcuccuguuacccugauucuagugaaaucacaugugugugcagggauaacuggcauggcucgaaucgaccgugggugucuuucaaccagaaucuggaauaucagaugggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggguauagcgggaguuuuguucagcauccagaacuaacagggcuggauuguauaagaccuugcuucuggguugaacuaauaagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56749 - RNA, 1410 nt, Artificial Sequence; identical to SEQ ID NO: 56748
  neuraminidase__InfluenzaA__EPI830229

SEQ ID NO: 56750 - RNA, 1410 nt, Artificial Sequence; identical to SEQ ID NO: 54341
  neuraminidase__InfluenzaA__AGU92879

SEQ ID NO: 56751 - RNA, 1410 nt, Artificial Sequence; identical to SEQ ID NO: 54340
  neuraminidase__InfluenzaA__AGU92857

SEQ ID NO: 56752 - RNA, 1410 nt, Artificial Sequence; identical to SEQ ID NO: 54339
  neuraminidase__InfluenzaA__AGU92846

SEQ ID NO: 56753 - RNA, 1410 nt, Artificial Sequence; identical to SEQ ID NO: 54350
  neuraminidase__InfluenzaA__AGU92835

SEQ ID NO: 56754 - RNA, 1410 nt, Artificial Sequence; identical to SEQ ID NO: 54326
  neuraminidase__InfluenzaA__AGU92703

SEQ ID NO: 56755 - RNA, 1410 nt, Artificial Sequence
  neuraminidase__InfluenzaA__EPI643117
augaauccaaaucaaaagauaauaacgauuggcucuguuucucucaccauuuccacaauaugcuucuucaugcaaauugccauuuugauaacuacuguaacauugcauuucaagcaauaugaauucaacucccccccaaacaaccaagugaugcugugugaaccaacaauaauagaaagaaacauaacagaaauaguguauuuaacuaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcauuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaagggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagacaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56756 - RNA, 1410 nt, Artificial Sequence
  neuraminidase__InfluenzaA__EPI675797
augaauccaaaucaaaagauaauaacgauuggcucuguuucucucaccauuuccacaauaugcuucuucaugcaaauugccauuuugauaacuacuguaacauugcauuucaagcaauaugaauucaacucccccccaaacaaccaagugaugcugugugaaccaacaauaauagaaagaaacauaacagaaauaguguauuuaacuaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacaaaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcauuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaagggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagacaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56757 - RNA, 1410 nt, Artificial Sequence; identical to SEQ ID NO: 56755
  neuraminidase__InfluenzaA__EPI578429

SEQ ID NO: 56758 - RNA, 1410 nt, Artificial Sequence; identical to SEQ ID NO: 56755
  neuraminidase__InfluenzaA__EPI614405

SEQ ID NO: 56759 - RNA, 1350 nt, Artificial Sequence; identical to SEQ ID NO: 56677
  neuraminidase__InfluenzaA__AAT73329

SEQ ID NO: 56760 - RNA, 1350 nt, Artificial Sequence
  neuraminidase__InfluenzaA__AAW80723
augaauccaaaucagaagauaauaaccaucggaucaaucuguaugguaacuggaauaguuagcuuaauguuacaaauugggaacaugaucucaauaugggucagucauucaauucacacagggaaucaacaccaaucugaaccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacgauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccuaaugccggagaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugccgaguugccauucaccauugacaaguag

SEQ ID NO: 56761 - RNA, 1350 nt, Artificial Sequence; identical to SEQ ID NO: 56760
  neuraminidase__InfluenzaA__EF541467

SEQ ID NO: 56762 - RNA, 1398 nt, Artificial Sequence; identical to SEQ ID NO: 55809
  neuraminidase__InfluenzaA__EPI439509

SEQ ID NO: 56763 - RNA, 1410 nt, Artificial Sequence
  neuraminidase__InfluenzaA__EPI482776
augaauacaaaucaaagaauaauaaccauugggacaguuugcaugauaguuggaauaaucagucuauuguuacagauaggaaacauagucucguuauggauuagccauucaauucagaccggaugggaaaaucacacugugaugugcaaccaaagugucauuacauauguaaauaacacaugggugaaccgaacuuaugugaacauuagcaauaucaagauugcuacuauacaggaugugacuucgauuauacuagccggcaauucaucacuuugcccaguaagugggugggcuguauacagcaaagacaauagcauaaggauugguucuaaaggggacauuuuugucauaagagaaccauucauuucaugcucucaauuggaaugcagaaccuuuuuucugacccaaggcgcuuugcugaaugacaaacauucuaauggaaccgucaaggacaggagucccuauagaacccugaugagcugccccaucggugaagccccaucuccguacaacucaagguucgaaucaguugcuuggucagcaagugcaugccaugaugggaugggauggcuaacaaucgggaucucugguccagauaauggagcaguagcuguuuuaaaauacaaugguauaauaacagauacaauaaaaaguuggagaaacaaaauauuaagaacacaagagucggaauguguuuguaugaacgguucuuguuuuacuguguuaacugaugguccaagcaaugggcaagccucguacaaaauauuuaaaguggaaaaaggaaaaauaauuaagucaauugagcuggaugcccccaauuaccacuaugaggaaugcucauguuauccugauacaggcaaaguaauguguguuugcagagacaauuggcaugccucgaaccggccaugggucucuuucaaucagaaucuugacuaccaaauaggauacauaugcaguggaguuuucggcgauaacccgcguuccaaugaugggaagggcaauuguggcccaguacuuucuaauggagcaaauggagugaaaggauucucauauagauaugguaaugguguuuggauaggaagaacuaagaguaucaacuccagaaguggauuugaaaugauuugggauccaaauggguggacugaaacugauaguaguuucucuaugaagcaggacauuauagcauugaaugauuggucaggauacaguggaaguuuuguccaacauccugaauuaacaggaaugaauugcauaaggccuuguuucuggguggaauuaaucagagggcaacccaaggaaagcacaaucugggcuagcggaagcagcaucucuuucuguggcguaaauagugaaaccgcaagcuggucauggccagacggagcugaucugccauucaccauugacaaguag

SEQ ID NO: 56764 - RNA, 1410 nt, Artificial Sequence
  neuraminidase__InfluenzaA__EPI745533
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaaaaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56765 - RNA, 1410 nt, Artificial Sequence; identical to SEQ ID NO: 47232
  neuraminidase__InfluenzaA__AEE69012

SEQ ID NO: 56766 - RNA, 1410 nt, Artificial Sequence; identical to SEQ ID NO: 47232
  neuraminidase__InfluenzaA__EPI176609

SEQ ID NO: 56767 - RNA, 1410 nt, Artificial Sequence; identical to SEQ ID NO: 47232
  neuraminidase__InfluenzaA__EPI176472

SEQ ID NO: 56768 - RNA, 1410 nt, Artificial Sequence
  neuraminidase__InfluenzaA__EPI280340
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugccggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagauaauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 56769 - RNA, 1410 nt, Artificial Sequence; identical to SEQ ID NO: 47241
  neuraminidase__InfluenzaA__EPI240318

SEQ ID NO: 56770 - RNA, 1410 nt, Artificial Sequence; identical to SEQ ID NO: 47241
  neuraminidase__InfluenzaA__EPI183133

SEQ ID NO: 56771 - RNA, 1410 nt, Artificial Sequence; identical to SEQ ID NO: 47241
  neuraminidase__InfluenzaA__EPI369141

SEQ ID NO: 56772 - RNA, 1410 nt, Artificial Sequence
  neuraminidase__InfluenzaA__EPI482787
augaauacaaaucaaagaauaauaaccauugggacagucugucugauaguuggaauaguuagucuauuauugcagauaggaaauauagucucauuauggauaagccauucaauucagacuggaaaaagaagccacccugaaacaugcagccaaaaugucauuacauaugaaaacaacacaugggugaaccaaacuuauguaaacaucagcaauaccaacauuguugauggacagggcguaacuucaauaauacuagccggcaauuccccucuuuguccaauaagugggugggcuauauacagcaaagacaacagcauaagaauugguuccaaaggagacauuuuugucauaagagaaccauucauuucaugcucucacuuggagugcagaacuuuuuuucugacccaaggugcuuugcugaaugacaggcauucuaauggaaccgucaaggacaggaguccuuauagaaccuuaaugagcugcccgauuggugaagcuccaucuccuuauaauucaagguucgaaucaguugcuuggucagcaagugcaugccaugauggaaugggguggcuaacaaucgggauuuccgguccagauaauggagcaguagcuguuuugaaauacaaugguauaauaacagauacaauaaaaaguuggagaaacaaaauacuaagaacacaagaaucagaauguguuuguauaaacgguucauguuucacuauaaugacugauggcccaagcaaugggcaggccucguacaaaauauucaaaauggagaaagggaagauuauuaagucaguugagcuggaugcaccuaacuaccacuaugaggaaugcuccuguuacccugauacaggcaagguggugugugugugcagagacaauuggcaugcuucgaaucgaccauggguuacuuuugaucagaaucuuaauuaucagauuggguacauaugcagugggguuuucggugauaacccgcguucuaaugaugggaaaggcaauuguggcccaguaccuucuaauggagcaaauggagugaaaggauucucauuuagauauggcaaugguguuuggauaggaagaacuaaaaguaucaguucuagaaguggauuugagaugauuugggauccaaauggauggacggaaacugauaguaguuucucuauaaagcaggauaucauagcauuaacugauuggucaggauauaguggaaguuuuguccagcaucccgaauuaacaggaaugaacugcauaaagccuuguuucuggguagaguuaaucagaggacaacccaaggagagcacaaucuggacuaguggaagcagcauuucuuucuguggcguggacagugaaaccguaagcuggucauggccagacggagcugauuugccauucaccauugacaaguag

SEQ ID NO: 56773 - RNA, 1410 nt, Artificial Sequence
  neuraminidase__InfluenzaA__EPI482790
augaauacaaaucaaagaauaauaaccauugguacaguuugucugauaguuggaauaauuagucuauuguuacagauaggaaacaugguuucguuauggaucagccauucaauucagacuggagggaaaaaucacacugagaugugcaaccaaaaugucauuacauauguaaauaacacaugggugaaccgaacuuauguaaacauuagcaauaccaaaauuguuaauguacaggacgugguuucaguaauauuaaccggcaauuccucucuuugcccaauaaguggaugggcuauauacagcaaagacaauagcauaaggauugguucuaaaggggacauuuuugucauaagagaaccauucauuucaugcucucacuuggaaugcagaacuuuuuuucugacccaaggugcuuugcugaaugacaagcauucuaauggaaccgucaaggacaggagucccuauagaaccuuaaugagcugccccgucggugaagcuccaucuccauauaacucaagguucgaaucaguugcuuggucagcaagugcaugccaugaugggaugggauggcuaacaaucggaaucuccgguccagauaauggagcaguagcuguuuuaaaauacaacgguauaauaacagauacaauaaaaaguuggagaaacaaaauauuaagaacacaagagucagaauguguuuguaugaacgguucuuguuuuacuguauuaacugauggcccaagcaaugggcaagcaucguacaaaauauucaagauggaaaaaggaaaaauaauuaaaucaauugagcuggaugcacccaauuaccacuaugaggaaugcuccuguuauccugaugcaggcaaaguaauguguguuugcagagacaacuggcaugccucgaaccggccaugggucucuuucgaucagaaucuugauuaucaaauaggguacauaugcagugggguuuucggugauaacccgcguucuaaugauggaaagggcaauuguggcccaguacauucuaauggagcaaauggagugaaaggauucucauauagauaugguaaugguguuuggauaggaaggacuaaaaguaucaacuccagaaguggguuugaaaugauuugggauccaaauggguggacuggaacugauaguaguuucucuaugaagcaggauauuauagcauuaacugauuggucaggauacaguggaaguuuuguccaacauccugaauuaacaggaaugaauugcauaaggcccuguuucuggguagaauuaaucagagggcaacccaaggaaaacacaaucugggcuagcggaagcagcaucucuuucugugguguaaauggugaaaccgcaagcuggucauggccagacggagcugaucugccauucaccauugacaaguag

SEQ ID NO: 56774 - RNA, 1410 nt, Artificial Sequence
  neuraminidase__InfluenzaA__EPI291797
augaauacaaaucaaagaauaauaaccauugggacaguuuguaugauaguuggaauaaucagucuauuguuacagauaggaaacauagucucguuauggauuagccauucaauucagaccggaugggaaaaucacacugagaugugcaaccaaagugucauuacauauguaaauaacacaugggugaaccgaacuuaugugaacauuagcaauaccaacauugcuacuauacaggaugugacuucgauuauacuagccggcaauuccucacuuugcccaguaaguggaugggcuauauacagcaaagacaauagcauaaggauugguucuaaaggggacauuuuugucauaagagaaccauucauuucaugcucucaauuggaaugcagaaccuuuuuucugacccaaggcgcuuugcugaaugacaagcauucuaauggaaccgucaaggacaggagucccuauagaacccugaugagcugccccaucggugaagcuccaucuccguacaacucaagguucgaaucaguugcuuggucagcaagugcaugccaugaugggaugggauggcuaacaaucgggaucucugguccagauaauggagcaguagcuguuuuaaaauacaacgguauaauaacagauacaauaaaaaguuggagaaacaaaauauuaagaacacaagagucggaauguguuuguaugaacgguucuuguuuuacuguauuaacugauggcccaagcaaugggcaagccucguacaaaauauuuaaaguggaaaaaggaaaaauaauuaagucaauugagcuggaugcccccaauuaccacuaugaggaaugcucauguuauccugauacaggcaaaguaauguguguuugcagagacaauuggcaugccucgaaccggccaugggucucuuucaaucagaaucuugacuaucaaauaggauacauaugcaguggaguuuucggugauaacccgcguucuaaugaugggaagggcaauuguggcccaguacuuucuaauggagcaaauggagugaaaggauucucauauagauaugguaaugguguuuggauaggaagaacuaagaguaucaacuccagaaguggguuugagaugauuugggauccaaauggguggacugaaacugauaguaguuucucuaugaagcaggacauuauagcauuaacugauuggucaggauacaguggaaguuuuguccaacauccugaauuaacaggaaugaauugcauaaggccuuguuucuggguggaauuaaucagagggcaacccaaggaaagcacaaucugggcuagcggaagcagcaucucuuucuguggcguaaauagugaaaccgcaagcuggucauggccagacggagcugaucugccauucaccauugacaaguag

SEQ ID NO: 56775 - RNA, 1410 nt, Artificial Sequence; identical to SEQ ID NO: 56774
  neuraminidase__InfluenzaA__EPI482798

SEQ ID NO: 56776 - RNA, 1410 nt, Artificial Sequence
  neuraminidase__InfluenzaA__EPI638969
augaauacaaaccaaagaauaauaaccauugggacaguuugcaugauaguuggaaugaucagucuauuguuacaaauaggaagcauagucucguuauggauuagccauucaauucagaccggaugggaaaaucacacuggggugugcaaccaaagugucauuacauauguaaauaacacaugggugaaccgaacuuaugugaacauuagcaauaucaagauugcuacuauacaggaugugacuccgauuauacuagccggcaauucaucacuuugcccaguaaaugggugggcuguauacagcaaagacaauagcauaaggauugguucuaaaggggacauuuuugucauaagagaaccauucauuucaugcucucaauuggaaugcagaaccuucuuucugacccaaggugcuuugcugaaugacaaacauucuaauggaaccgucaaggacaggagucccuauagaacccugaugagcugccccaucggugaagccccaucuccguacaacucaagguucgaaucaguugcuuggucagcaagugcaugccaugaugggaugggauggcuaacaaucgggaucucugguccagauaauggagcaguagcuguuuuaaaauacaacgguauaauaacagauacaauaaaaaguuggagaaacaaaauauuaagaacacaagagucggaguguguuuguaugaacgguucuuguuuuacuguauugacugauggcccaagcaaugggcaagccucguacaaaauauuuaaaguggaaaaaggaaaaauaauuaagucaauugagcuggaugcccccaauuaccacuaugaagaaugcucauguuauccugauacaggcaaaguaauguguguuugcagagacaauuggcaugccucgaaccggccaugggucucuuucaaucagaaucuugacuaucaaauaggauacauaugcaguggaguuuucggugauaacccucguucuaccgaugggaagggcaauuguggcccaguacuuucuaauggagcaaauggagugaaaggauucucauauagguaugguaaugguguuuggauaggaagaacuaagaguaucaacuccagaaguggauuugaaaugauuugggauccaaauggguggacugaaacugauaguaguuucucuaugaagcaggacauuauagcauugaaugauuauucaggauacaguggaaguuuuguccaacauccugaauuaacaggaaugaauugcauaaggccuuguuucuggguggaguuaaucagagggcaacccaaggaaagcacaaucugggcuagcggaagcagcaucucuuucuguggcguaaauagugaaaccgcaagcuggucauggccagacggagcugaucugccauucgccauugacaaguag

SEQ ID NO: 56777 - RNA, 1410 nt, Artificial Sequence
  neuraminidase__InfluenzaA__ABI19012
augaauacaaaucaaagaauaauaaccauugggacaguuugucugauaguuggaauaauuagucuauuguuacagauaggaaacauggucucguuauggauuagccauucaauucagaccggagggaaaaaucacacugagaugugcaaccaaaaugucauuacauauguaaauaacacaugggugaaccgaacuuauguaaacauuagcaauaccaaaauuguuaauguacaggacgugguuucaguaauacuaaccggcaauuccucucuuugcccaauaagugggugggcuauauacagcaaagacaauagcauaaggauugguucuaaaggggacauuuuugucauaagagaaccauucauuucaugcucucacuuggaaugcagaacuuuuuuucugacccaaggcgcuuugcugaaugacaagcauucuaauggaaccgucaaggacaggagucccuauagaaccuuaaugagcugccccaucggugaagcuccaucuccguauaacucaagguucgaaucaguugcuuggucagcaagugcaugccaugaugggaugggauggcuaacaaucgggaucuccgguccagauaauggagcaguagcuguuuuaaaauacaacgguauaauaacagacacaauaaaaaguuggagaaacaaaauauuaagaacacaagagucagaauguguuuguaugaacgguucuuguuuuacuguauuaacugauggcccaagcaaugggcaagccucguacaaaauauucaaaauggaaaaaggaaaaauaauuaaaucaauugagcuggaugcacccaauuaccacuaugaggaaugcuccuguuauccugaugcaggcaaaguaauguguguuugcagagacaacuggcaugccucgaaccggccaugggucucuuucgaucagaaucuugacuaucagauaggguacauaugcagugggguuuucggugauaacccgcguucuaaugauggaaagggcaauuguggcccaguacauucuaauggagcaaauggagugaaaggauucucauauagauaugguaaugguguuuggauaggaagaacuaaaaguaucaacuccagaaguggguuugagaugauuugggauccaaauggguggacuggaacugauaguaguuucucuaugaagcaggauauuauagcauuaacugauuggucaggauacaguggaaguuuuguccggcauccugaauuaacaggaaugaauugcauaaggccuuguuucuggguagaauuaaucagagggcaacccaaggaaaacacaaucugggcuagcggaagcagcaucucuuucuguggcguaaauggugaaaccgcaagcuggucauggccagacggagcugaucugccauucaccauugacaaguag

SEQ ID NO: 56778 - RNA, 1410 nt, Artificial Sequence
  neuraminidase__InfluenzaA__EPI687791
augaauccaaaccaaaagauaauaaccauugguucgaucuguaugacaauuggaauggcuaacuuaauauuacaaauuggaaacauaaucucaauauggguuagccacucaauucaaauuggaaaucaaagccagauugaaacaugcaaucaaagcgucauuacuuaugaaaacaacacuuggguaaaucagacauauguuaacaucagcaacaccaacuuugcugcuagacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaaaaucuucagaauagaaaagggaaagauaaucaaaucagucgaaaugaaagccccuaauuaucacuaugaggaaugcuccuguuacccugauucuagugaaaucacaugugugugcagggauaacuggcauggcucgaaucgaccgugggugucuuucaaccagaaucuggaauaucagaugggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggguauagcgggaguuuuguucagcauccagaacuaacagggcuggauuguauaagaccuugcuucuggguugaacuaauaagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56779 - RNA, 1410 nt, Artificial Sequence
  neuraminidase__InfluenzaA__EPI841266
augaauccaaaccaaaagauaauaaccauugguucgaucuguaugacaauuggaauggcuaacuuaauauuacaaauuggaaacauaaucucaauauggguuagccacucaauucaaauuggaaaucaaagccagauugaaacaugcaaucaaagcgucauuacuuaugaaaacaacacuuggguaaaucagacauauguuaacaucagcaacaccaacuuugcugcuagacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaaaaucuucagaauagaagagggaaagauaaucaaaucagucgaaaugaaagccccuaauuaucacuaugaggaaugcuccuguuacccugauucuagugaaaucacaugugugugcagggauaacuggcauggcucgaaucgaccgugggugucuuucaaccagaaucuggaauaucagaugggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggguauagcgggaguuuuguucagcauccagaacuaacagggcuggauuguauaagaccuugcuucuggguugaacuaauaagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56780 - RNA, 1410 nt, Artificial Sequence
  neuraminidase__InfluenzaA__EPI291844
augaauacaaaccaaagaauaauaaccauugggacaguuugucugauaguuggaauaauuagucuauuguuacagauaggaaccaugguuucguuauggaucagccacucaauucagacuggagggaaaaaucacacugagaugugcaaccaaaaugucauuacauauguaaauaacacaugggugaaccgaacuuauguaaacauuagcaauaccaaaauuguuaauguacaggacgugguuucaguaauauugaccggcaauuccucucuuugcccaauaagugggugggcuauauacagcaaagacaauagcauaaggauugguucuaaaggggacauuuuugucauaagagaaccauucauuucaugcucucacuuggaaugcagaacuuuuuuucugacccaaggcgcuuugcugaaugacaagcauucuaauggaacugucaaggacaggagucccuauagaaccuuaaugagcugccccaucggugaagcuccaucuccauauaacucaagguucgaaucaguugcuuggucagcaagugcaugccaugaugggaugggauggcuaacaaucggaaucuccgguccagauaauggagcaguagcuguuuuaaaauacaacgguauaauaacagauacaauaaaaaguuggagaaacaaaauauuaagaacacaagagucagaauguguuuguaugaacgguucuuguuuuacuguauuaacugauggcccaagcaaugggcaagcaucguacaaaauauucaagauggaaaagggaaaaauaauuaaaucaauugagcuggaugcaccuaauuaccacuaugaggaaugcuccuguuauccugaugcaggcaaaguaauguguguuugcagagacaacuggcaugcuucgaaccggccaugggucucuuuugaucagaaucuugauuaucaaauaggguacauaugcagugggguuuucggugauaacccgcguucuaaugauggaaagggcaauuguggcccaguacauucuaauggagcaaauggagugaaaggauucucauauaaauaugguaaugguguuuggauaggaaggacuaaaaguaucaacuccagaaguggguuugaaaugauuugggauccaaauggguggacuggaacugauaguaguuucucuaugaagcaggauauuauagcauuaacugauuggucaggauacaguggaaguuuuguccaacauccugaauuaacaggaaugaauugcauaaggcccuguuucuggguagaauuaaucagagggcaacccaaggaaaacacaaucugggcuaguggaagcagcaucucuuucugugguguaaauggugaaaccgcaagcuggucauggccagacggagcugaucugccauucaccauugacaaguag

SEQ ID NO: 56781 - RNA, 1410 nt, Artificial Sequence
  neuraminidase__InfluenzaA__EPI558120
augaauacaaaucaaagaauaauaaccauugggacaguuugcaugauaguuggaauuaucagucuauuguuacagauaggaaacauagucucauuauggauuagccauucaauucagaccggaugggaaaaucacacugagaugugcaaccaaagugucauuacauauguaaauaacacauggaugaaccgaacuuaugugaacauuagcaauaucaaaauugcuacuauacaggauguaacuucgauuguacuagccggcaauucaucacuuugcccaguaagugggugggcuguauacagcaaagacaauagcauaaggauuggcucuaaaggggacauuuuugucauaagagaaccauucauuucaugcucucaauuggaaugcagaaccuuuuuucugacccaaggcgcuuugcugaaugacaaacauucuaauggaaccgucaaggacaggagucccuauagaacccugaugagcugccccaucggugaagccccaucuccguacaacucaagguucgaaucaguugcuuggucagcaagugcaugccaugaugggaugggauggcuaacaaucgggaucucuggcccagauaauggagcaguagcuguuuuaaaauacaacgguauaauaacagauacaauaaaaaguuggagaaacaaaauauuaaggacacaagagucggaauguguuuguauaaaugguucuuguuuuacuguguuaacugaugguccaagcaauggucaagccucguacaaaauauuuaaaguggaaaaaggaaaaauaauuaagucaauugagcuggacgcccccaauuaccacuaugaggaaugcucauguuauccugauacaggcaaaguaauguguauuugcagagacaauuggcaugccucgaaccggccaugggucucuuucgaucagaaucuugacuaucaaauaggauacauaugcaguggaguuuucggugauaacccgcguuccaaugaugggaagggcaauugcggcccaguacuuucuaauggagcaaauggagugaaaggauucucauauagauaugguaaugguguuuggauaggacgaacuaagaguaucaacuccagaaguggauuugaaaugauuugggauccaaauggguggacugaaacugauaguaguuucucuaugaagcaggacauuauagcauugaaugauuggucaggauacaguggaaguuuuguccaacauccugaauuaacaggaaugaauugcauaaggccuuguuucuggguggaauuaaucagaggacaacccaaggaaagcacaaucugggcuagcggaagcagcaucucuuucuguggcguaaauagugaaaccgcaagcuggucauggccagacggagcugaucugccauucaccauugacaaguag

SEQ ID NO: 56782 - RNA, 1410 nt, Artificial Sequence
  neuraminidase__InfluenzaA__EPI564138
augaauccaaaucaaaagauaauaacgauuggcucuguuucucucaccaucuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucgugguccaaagauauucucaggacccaggagucagaaugcguuuguaucaauggaacuuguacaguaguaaugacugauggaagugcuucaggaaaagcugauacuaaaauacuauucauugaggaggggaaaaucguccauacuagcaaauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggauggggagaacaaucaacgagacgucacgcuuaggguaugaaaccuucaaagucguugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56783 - RNA, 1410 nt, Artificial Sequence
  neuraminidase__InfluenzaA__ANM92825
augaauccaaaccaaaagauaauaaccauugguucgaucuguaugacaauuggaauggcuaacuuaauauuacaaauuggaaacauaaucucaauauggguuagccacucaauucaaauuggaaaucaaagccagauugaaacaugcaaucaaagcgucauuacuuaugaaaacaacacuuggguaaaucagacauauguuaacaucagcaacaccaauuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaacaauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaaaaucuucagaauagaaaagggaaagauaaucaaaucagucgaaaugaaagccccuaauuaucacuaugaggaaugcuccuguuacccugauucuagugaaaucacaugugugugcagggauaacuggcauggcucgaaucgaccgugggugucuuucaaccagaaucuggaauaucagaugggauacauaugcagugggguuuucggagacaauccacgcccuaaugauaagacaggcaauugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggguauagcgggaguuuuguucagcauccagaacuaacagggcuggauuguauaagaccuugcuucuggguugaacuaauaagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56784 - RNA, 1410 nt, Artificial Sequence
  neuraminidase__InfluenzaA__EPI291694
augaauacaaaccaaagaauaauaaccaucggaacagucugucugauaguuggaauaguuagucuauuauugcagauaggaaauauagucucguuauggauaagccauucaauucagacuggagaaaaaaaccacucugagguaugcaaccaaaauaucauuacauaugaaaacaaaacaugggugaaccaaacuuauguaaacauuagcaauaccaacauugcugagggacagggcgugacuucaauaauacuagccggcaauuccucucuuugcccaguaagugggugggcuauauacagcaaagacaauagcauaaggauugguuccaaaggagacauuuuugucauaagagaaccauucauuucaugcucucacuuggagugcagaaccuuuuuucugacccaaggugcuuugcuaaaugacaggcauucuaauggaaccgucaaggacaggagcccuuacagaaccuuaaugagcugccugaccggugaagcuccaucuccguacaauucaagauuugaaucaguugcuuggucagcaagugcaugccaugauggaaugggauggcuaacaaucgggauuuccgguccagauaauggagcaguggcuguuuugaaauacaaugguauaauaacagauacaauaaaaaguuggagaaacaaaauacuaagaacacaagagucagaauguguuuguauaaacgguucauguuuuacuauaaugacugauggcccaagcaaugggcaagccucguacaaaauauucaaaauggagaaagggaagauuauuaagucaguugagcuggaugcaccuaauuaccacuaugaggaaugcuccuguuacccugauacaggcaaaguggugugugugugcagagacaauuggcaugcuucaaaucgaccgugggucucuuucgaucagaaucuugauuaucagauaggguacauaugcagugggguuuucggugauaacccgcguucuaaugaugggaaagguaauuguggcccaguaccuucuaauggagcaaauggagugaagggauucucauuuagauaugguaaugguguuuggauaggaagaacuaaaaguaucaucucuagaaguggauuugagaugauuugggacccaaauggauggacggaaacugauaguaguuucucuauaaagcaggauauuauagcauuaacugauuggucaggauacaguggaaguuuuguccaacauccugaauuaacaggaaugaacugcauaaggccuuguuuuuggguagaguuaaucagaggacaacccaaggagaguacaaucuggacuagugggagcagcauuucuuucuguggcguggacagugaaacugcaagcuggucauggccagacggggcugaucugccauucaccauugacaaguag

SEQ ID NO: 56785 - RNA, 1410 nt, Artificial Sequence; identical to SEQ ID NO: 47718
  neuraminidase__InfluenzaA__EPI241027

SEQ ID NO: 56786 - RNA, 1410 nt, Artificial Sequence; identical to SEQ ID NO: 47242
  neuraminidase__InfluenzaA__EPI177405

SEQ ID NO: 56787 - RNA, 1410 nt, Artificial Sequence; identical to SEQ ID NO: 47516
  neuraminidase__InfluenzaA__EPI242475

SEQ ID NO: 56788 - RNA, 1410 nt, Artificial Sequence
  neuraminidase__InfluenzaA__EPI590131
augaaugcaaaucaaagaauaauaaccauugggacaguuugucugauaauuggaauaauuagucuauuguuacagauagggaacaugguuucguuguggaucagccauucaauucagacuggagggaaaaaucacacugagaugugcaaucaaaaugucaucacauauguaaacaacacaugggugaaccgaacuuauguaaacaucagcaauaccaaaauuguuaauguacaagacgugguuucgguaauauuaaccggcaauuccucucuuugcucaauaaguggcugggcuauauacagcaaagacaauagcauaaggauugguucuaaaggagacauuuuugucauaagagaaccauucauuucaugcucucacuuggaaugcagaacuuuuuuccugacccaaggcgcuuugcugaaugacaagcauucuaaugggaccgucaaggacaggagucccuauagaacuuuaaugagcugucccauuggugaagcuccaucuccauauaacucaagauucgaaucaguugcuuggucagcaagugcaugccaugaugggauaggauggcugacaaucggaaucuccgguccagauaauggagcaguagcuguuuuaaaauacaacgguauaauaacagauacaauaaaaaguuggagaaacaaaauauuaagaacacaagagucugaauguguuuguaugaacgguucuugcuuugcuguauuaacugauggcccaagcaaugggcaagcaucguacaaaauauucaaagugaaacaagggaaaauaauuaaaucaauugagcuggaugcacccaauuaccacuaugaggaaugcuccuguuauccugaugcaggcaaaguaauguguguuugcagagacaacuggcaugccucgaaucggccaugggucucuuucgaucaggaucuuaacuaucaaauaggguacauaugcagugggguuuucggugauaacccgcguucuaaugauggaaagggcaauuguggcccuguacauucuaauggagcaaauggagugaaaggauucucauauagauaugguaaugguguuuggauaggaaggacuaaaaguauccacuccagaaguggguuugaaaugauuugggauccaaauggguggacugggacugauaguaguuucucuaugaagcaggauauuauagcauuaacugauuggucaggauacagugggaguuuuguccaacauccugaauuaacaggaaugaauugcauaaggcccuguuucuggguagaauuaaucagagggcaacccaaagaaaacaccaucugggcuagcggaagcagcaucuccuucugugguguaaauggugaaaccgcaagcuggucauggccagacggagcugaucugccauucaccauugacaaguag

SEQ ID NO: 56789 - RNA, 1410 nt, Artificial Sequence
  neuraminidase__InfluenzaA__EPI68596
augaauacaaaucaaagaauaauaaccauugggacagucugucugauaguuggaauaguuagucuauuauugcagauaggaaauauagucucguuauggauaagccauucaauucagacuggagaaaaaaaccacucugagauaugcagccaaaaugucauuacauaugaaaacaacacaugggugaaccaaacuuauguaaacauuagcaauaccaacauugcugauggacagggcgugacuucaauaauacuagccggcaauuccucucuuugcccaauaagugggugggcuauauacagcaaagacaauagcauaaggauugguuccaaaggagacauuuuugucauaagagaaccauucauuucaugcucucacuuggagugcagaaccuuuuuucugacccaaggugcuuugcuaaaugacaggcauucuaauggaaccgucaaggacaggagcccuuaccgaaccuuaaugagcugcccgaucggugaagcuccaucuccguauaauucaagauucgaaucaguugcuuggucagcaagugcaugccaugauggaaugggauggcuaacaaucgggauuuccgguccagauaauggagcaguggcuguuuugaaauacaaugguauaauaacagauacaauaaaaaguuggagaaacaaaauacuaagaacacaagagucagaauguguuuguauaaacgguucauguuuuacuauaaugacugauggcccaagcaaugggcaggccucguacaaaauauucaaaauggagaaagggaagauuauuaagucaguugagcuggaugcaccuaauuaccacuaugaggaaugcuccuguuacccugauacaggcaaaguggugugugugugcagagacaauuggcaugcuucaaaucgaccgugggucucuuucgaucagaaucuugauuaucagauaggguacauaugcagugggguuuucggugauaacccgcguucuaaugaugggaaaggcaauuguggcccaguacuuucuaauggagcaaauggagugaaaggauucucauuuagauauggcaaugguguuuggauaggaagaacuaaaaguaucagcucuagaaguggauuugagaugauuugggauccaaauggauggacggaaacugauaguaguuucucuauaaagcaggauauuauagcauuaacugauuggucaggauacaguggaaguuuuguccaacauccugaauuaacaggaaugaacugcauaaggccuuguuucuggguagaguuaaucagaggacaacccaaggagagcacaaucuggacuaguggaagcagcauuucuuucuguggcguggacagugaaaccgcaagcuggucauggccagacggagcugaucugccauucaccauugacaaguag

SEQ ID NO: 56790 - RNA, 1365 nt, Artificial Sequence
  neuraminidase__InfluenzaA__EPI115409
augaauccaaaucagaaaauaauaaccauuggaucaaucugucugguagucggacuaauuagccuaauauugcaaauagggaauauaaucucaauauggauuagccauucaauucaaacuggaagucaaaaccauacuggaauaugcaaccaaaacaucauuaccuauaaaaauagcaccuggguaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaagcauucaagugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucgauagaguugaaugcaccuaauucucacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccgaagauggaacaggcagcugugguccaguguauguugauggagcaaacggaguaaagggauuuucauauagguaugguaaugguguuuggauaggaaggaccaaaagucacaguuccagacauggguuugagaugauuugggauccuaauggauggacagagacugauaguaaguucucugugaggcaagauguuguggcaaugacugauuggucaggguauagcggaaguuucguucaacauccugagcugacagggcuagacuguaugaggccgugcuucuggguugaauuaaucaggggacgaccuaaagaaaaaacaaucuggacuagugcgagcagcauuucuuuuuguggcgugaauagugauacuguagauuggucuuggccagacggugcugaguugccauucagcauugacaaguag

SEQ ID NO: 56791 - RNA, 1365 nt, Artificial Sequence; identical to SEQ ID NO: 47198
  neuraminidase__InfluenzaA__ABD77678/m1

SEQ ID NO: 56792 - RNA, 1410 nt, Artificial Sequence; identical to SEQ ID NO: 47241
  neuraminidase__InfluenzaA__EPI185224

SEQ ID NO: 56793 - RNA, 1410 nt, Artificial Sequence
  neuraminidase__InfluenzaA__EPI697745
augaauccaaaccaaaagauaauaaccauugguucgaucuguaugacaauuggaauggcuaacuuaauauuacaaauuggaaacauaaucucaauauggguuagccacucaauucaaauuggaaaucaaagccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaaaaucuucagaauagaaaagggaaagauaaucaaaucagucgaaaugaaagccccuaauuaucacuaugaggaaugcuccuguuacccugauucuagugaaaucacaugugugugcagggauaacuggcauggcucgaaucgaccgugggugucuuucaaccagaaucuggaauaucagaugggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggguauagcgggaguuuuguucagcauccagaacuaacagggcuggauuguauaagaccuugcuucuggguugaacuaauaagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56794 - RNA, 1410 nt, Artificial Sequence; identical to SEQ ID NO: 56793
  neuraminidase__InfluenzaA__EPI768524

SEQ ID NO: 56795 - RNA, 1410 nt, Artificial Sequence
  neuraminidase__InfluenzaA__EPI726929
augaauccaaaccaaaagauaauaaccauugguucgaucaguaugacaauuggaauggcuaacuuaauauuacaaauuggaaacauaaucucaauauggguuagccacucaauucaaauuggaaaucaaagccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaagaguuggaggaacaauauauugagaacacaagagucugaaugugcauguguaaaugguucuugcuuuaccauaaugaccgauggaccaagugauggacaggccucauacaaaaucuucagaauagaaaagggaaagauaaucaaaucagucgaaaugaaagccccuaauuaucacuaugaggaaugcuccuguuacccugauucuagugaaaucacaugugugugcagggauaacuggcauggcucgaaucgaccgugggugucuuucaaccagaaucuggaauaucagaugggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacugacaauaaauucucaauaaagcaagauaucguaggaauaaaugaguggucaggguauagcgggaguuuuguucagcauccagaacuaacagggcuggauuguauaagaccuugcuucuggguugaacuaauaagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56796 - RNA, 1410 nt, Artificial Sequence; identical to SEQ ID NO: 56795
  neuraminidase__InfluenzaA__EPI813816

SEQ ID NO: 56797 - RNA, 1410 nt, Artificial Sequence
  neuraminidase__InfluenzaA__EPI466627
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaaaaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguagggauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56798 - RNA, 1410 nt, Artificial Sequence
  neuraminidase__InfluenzaA__EPI541965
augaauccaaaccaaaagauaauaaccauugguucggucuguaugacaauuggaauggcuaacuuaauauuacaaauuggaaacauaaucucaauauggguuagccacucaauucaacuugggaaucaaagucagauugaaacaugcaaucaaagcgucauuacuuaugaaaacaacacuuggguaaaucagacauauguuaacaucagcaacaccaacuuugcugcuggacagccagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuuggcucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaaaaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguagggauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56799 - RNA, 1410 nt, Artificial Sequence
  neuraminidase__InfluenzaA__EPI652004
augaauccaaaccaaaagauaauaaccauugguucggucuguaugacaauuggaauggcuaacuuaauauuacaaauuggaaacauaaucucaauauggguuagccacucaauucaaauugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuuggcucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaauggcauaauaacagacacuaucaaaaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaauggauggacugggacagacaauaacuucucaauaaagcaagauaucguagggauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 56800 - RNA, 1410 nt, Artificial Sequence
  neuraminidase__InfluenzaA__EPI62526
augaauacaaaucaaagaauaauaaccauugggacagucugucugauaguuggaauaguuagucuauuauugcagauaggaaauauagucucguuauggauaagccauucaauucagacuggagaaaaaaaccacccugagauaugcagccaaaaugucauuacauaugaaaacaacacaugggugaaccaaacuuauguaaacauuagcaauaccaacauuguugauggacaaggcgugacuucaauaauacuagccggcaauuccucucuuugcccaauaagugggugggcuauauacagcaaagacaauagcauaaggauugguuccaaaggagacauuuuugucauaagagaaccauucauuucaugcucucacuuggagugcagaaccuuuuuucugacccaaggugcuuugcugaaugacaggcauucuaauggaaccgucaaggacaggaguccuuauagaaccuuaaugagcugcccgauuggugaagcuccaucuccguauaauucaagguucgaaucaguugcuuggucagcaagugcaugccaugauggaaugggauggcuaacaaucgggauuuccgguccagauaauggagcaguggcuguuuugaaauacaaugguauaauaacagauacaauaaaaaguuggagaaacaaaauacuaagaacacaagagucagaauguguuuguauaaacgguucauguuuuacuauaaugacugauggcccaagcaaugggcaggccucguacaaaauauucaaaauggagaaagggaagauuauuaagucaguugagcuggaugcaccuaauuaccacuaugaggaaugcuccuguuacccugauacaggcaaaguggugugugugugcagagacaauuggcaugcuucgaaucgaccaugggucucuuucgaucagaaucuugauuaucagauaggguacauaugcagugggguuuucggugauaacccgcguucuaaugaugggaaaggcaauuguggcccaguacuuucuaauggagcaaauggagugaaaggauucucauuuagauauggcaaugguguuuggauaggaagaacuaaaaguaucagcucuagaaguggauuugagaugauuugggauccaaauggauggacggaaacugauaguaguuucucuauaaagcaggauauuauagcauuaacugauuggucaggauacaguggaaguuuuguccaacaucccgaauuaacaggaaugaacugcauaaggccuuguuucuggguagaguuaaucagaggacaacccaaggagagcacaaucuggacuaguggaagcagcauuucuuucuguggcguggacagugaaaccgcaagcuggucauggccagacggagcugaucugccauucaccauugacaaguag

SEQ ID NO: 56801 - RNA, 1410 nt, Artificial Sequence; identical to SEQ ID NO: 47241
  neuraminidase__InfluenzaA__EPI189183

SEQ ID NO: 56802 - RNA, 1410 nt, Artificial Sequence; identical to SEQ ID NO: 47232
  neuraminidase__InfluenzaA__EPI180576

SEQ ID NO: 56803 - RNA, 1410 nt, Artificial Sequence
  neuraminidase__InfluenzaA__EPI346918
augaauacaaaucaaagaauaauaaccauugggacaguuuguaugauaguugguauaaucagucuauuguuacagauaggaaacauagucucguuauggauuagccauucaauucagaccggaugggaaaaucacacugagaugugcaaccaaaaugucauuacauauguaaauaacacaugggugaaccgaacuuaugugaacguuagcaauaccaacauugcuacuauacaggaugugacuucgauuguacuagccggcaauuccucacuuugcccaguaaguggaugggcuauauacagcaaagacaauagcauaagaauugguucuaaaggggacauuuuugucauaagagaaccauucauuucaugcucucaauuggaaugcagaaccuuuuuucugacccaaggugcuuugcugaaugacaagcauucuaauggaaccgucaaggacaggagucccuauagaacccugaugagcugccccaucggugaagcuccaucuccauacaacucaagguucgaaucaguugcuuggucagcaagugcaugccaugaugggaugggauggcuaacaaucgggaucucugguccagauaauggagcaguagcuguuuuaaaauacaaugguauaauaacagauacaauaaaaaguuggagaaacaaaauauuaagaacacaagagucggaauguguuuguaugaaugguucuuguuuuacuguauuaacugaugggccaagcaaugggcaagccucguacaaaauauuuaaaguggaaaaagggagaauaauuaagucaauugagcuggaugcccccaauuaccacuaugaggaaugcucauguuauccugauacaggcaaaguaauguguguuugcagagacaauuggcaugccucgaaccggcccugggucucuuucaaucagaaucuugacuaucaaauaggguacauaugcaguggaguuuucggugauaacccacguucuaaugaugggaagggcaauuguggcccaguacuuucuaauggagcaaauggagugaaaggauucucauauagauauggcaaugguguuuggauaggaagaacuaagaguaucaacuccagaagaggguuugagaucauuugggauccaaauggguggacugaaacugauaguaguuucucuaugaagcaggacauuauagcauuaacugauuggucaggauacaguggaaguuuuguccaacauccugaauuaacaggaaugaauugcauaaggccuuguuucuggguggaauuaaucagagggcaacccaaggaaagcacaaucugggcuagcggaagcagcaucucuuucuguggcguaaauagugaaaccgcaagcuggucauggccagacggagcugaucugccauucaccauugacaaguag

SEQ ID NO: 56804 - RNA, 1410 nt, Artificial Sequence; identical to SEQ ID NO: 47820
  neuraminidase__InfluenzaA__EPI240976

SEQ ID NO: 56805 - RNA, 1410 nt, Artificial Sequence; identical to SEQ ID NO: 44611
  neuraminidase__InfluenzaA__EPI3165

SEQ ID NO: 56806 - RNA, 1410 nt, Artificial Sequence; identical to SEQ ID NO: 56525
  neuraminidase__InfluenzaA__EPI957

SEQ ID NO: 56807 - RNA, 1410 nt, Artificial Sequence
  neuraminidase__InfluenzaA__EPI507593
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaaucggcccaucguagauauaaauauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56808 - RNA, 1410 nt, Artificial Sequence; identical to SEQ ID NO: 56807
  neuraminidase__InfluenzaA__EPI461954

SEQ ID NO: 56809 - RNA, 1410 nt, Artificial Sequence; identical to SEQ ID NO: 56807
  neuraminidase__InfluenzaA__EPI461954

SEQ ID NO: 56810 - RNA, 1410 nt, Artificial Sequence
  neuraminidase__InfluenzaA__EPI668104
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuucuaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcguuuguaucaauggaacuuguacaguaguaaugacugauggaaaugcuucaggaaaagcugauacuaaaauacuauucauugaggaggggaaaaucguucauacuagcaaauugucaggaagugcucagcaugucgaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggauggggagaacaaucaacgagacgucacgcuuaggguaugaaaccuucaaagucguugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56811 - RNA, 1410 nt, Artificial Sequence
  neuraminidase__InfluenzaA__EPI578445
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcguuuguaucaauggaacuuguacaguaguaaugacugauggaaaugcuucaggaaaagcugauacuaaaauacuauucauugaggaggggaaaaucguucauacuagcaaauugucaggaagugcucagcaugucgaagagugcucuugcuauccucgauauccuggugucagaugugucugcagagacaacuggaaaggauccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggauggggagaacaaucaacgagacgucacgcuuaggguaugaaaccuucaaagucguugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56812 - RNA, 1410 nt, Artificial Sequence; identical to SEQ ID NO: 56811
  neuraminidase__InfluenzaA__EPI551883

SEQ ID NO: 56813 - RNA, 1410 nt, Artificial Sequence
  neuraminidase__InfluenzaA__EPI344388
augaauccaaaucaaaagauaauaacaauuggcucuguuucucucaucauugccacaauauguuuccuuaugcaaauugcuauccuaguaacuacuguaacauuacauuucaagcagcaugacuacaacucccccccaaacaaccaagcaaugcugugugaaccaacaauaauagaaagaaacacaacagagauuguguauuugaccaacaccaccauagagaaagaaauaugccccaaacuagcagaauauagaaacuggucaaagccgcaauguaacauuacaggauuugcaccuuuuucuaaggacaauucaauucggcuuucugcugguggggacaucugggugacaagagaaccuuaugugucaugcgauccugacaaguguuaucaauuugcccuugggcagggaacaacauuaaacaacggacauucaaauaacacuguacaugauaggaccccuuaucgaacccuauugaugaaugaauuggguguuccauuucauuuaggaaccaggcaagugugcauggcaugguccagcucaaguugucacgauggaaaagcauggcugcauguuuguauaacugggaaugauaacaaugcaacagcuagcuucauuuacaaugggaggcuuguagauaguauugguucaugguccaaaaauauacucagaacccaggagucggaaugcgucuguaucaauggaaccuguacaguaguaaugacugaugggagcgcuucaggaaaagcugauacuaaaauacuauucguugaggaggggaagaucguucauauuagcacauugucaggaagugcucagcauguugaggagugcuccuguuauccucgauuuccuggugucagaugugucugcagagacaacuggaaaggcuccaauaggcccaucguagauauaaauguaaagaauuauagcauuguuuccaguuauguaugcucaggacuuguuggagacacacccagaaaaagugacagcgucagcaguaguuauugccuagauccuaacaaugagaaagguggucauggggugaaaggcugggccuuugaugauggaaaugacguguggaugggaaggacaaucaacgagacguuacgcuuagguuaugaaaccuucaaaguaauugaaggcugguccaaagcuaacuccaaauuacagacaaauaggcaagucauaguugaaaaaggugacagguccgguuauucugguauuuucuccguugaagguaaaagcugcaucaaucggugcuuuuauguggaguugauaaggggaaggaaagaggaaacuaaagucugguggaccucaaacaguauuguuguguuuuguggcaccucagguacauauggaacaggcucauggccugauggagcggauaucaaucucaugccuauauaa

SEQ ID NO: 56814 - RNA, 1410 nt, Artificial Sequence
  neuraminidase__InfluenzaA__EPI347601
augaauccaaaucaaaagauaauaacaauuggcucuguuucucucaucauugccacaauauguuuccuuaugcaaauugcuauccuaguaacuacuguaacauuacauuucaagcagcaugacuacaacucccccccaaacaaccaagcaaugcugugugaaccaacaauaauagaaagaaacacaacagagauuguguauuugaccaacaccaccauagagaaagaaauaugccccaaacuagcagaauauagaaacuggucaaagccgcaauguaacauuacaggauuugcaccuuuuucuaaggacaauucaauucggcuuucugcugguggggacaucugggugacaagagaaccuuaugugucaugcgauccugacaaguguuaucaauuugcccuugggcagggaacaacauuaaacaacggacauucaaauaacacuguacaugauaggaccccuuaucgaacccuauugaugaaugaauuggguguuccauuucauuuaggaaccaggcaagugugcauggcaugguccagcucaaguugucacgauggaaaagcauggcugcauguuuguauaacugggaaugauaacaaugcaacagcuagcuucauuuacaaugggaggcuuguagauaguauugguucaugguccaaaaauauacucagaacccaggagucagaaugcgucuguaucaauggaaccuguacaguaguaaugacugaugggagcgcuucaggaaaagcugauacuaaaauacuauucguugaggaggggaagaucguucauauuagcacauugucaggaagugcucagcauguugaggagugcuccuguuauccucgauuuccuggugucagaugugucugcagagacaacuggaaaggcuccaauaggcccaucguagauauaaauguaaagaauuauagcauuguuuccaguuauguaugcucaggacuuguuggagacacacccagaaaaagugacagcgucagcaguaguuauugccuagauccuaacaaugagaaagguggucauggggugaaaggcugggccuuugaugauggaaaugacguguggaugggaaggacaaucaacgagacguuacgcuuagguuaugaaaccuucaaaguaauugaaggcugguccaaagcuaacuccaaauuacagacaaauaggcaagucauaguugaaaaaggugacagguccgguuauucugguauuuucuccguugaagguaaaagcugcaucaaucggugcuuuuauguggaguugauaaggggaaggaaagaggaaacuaaagucugguggaccucaaacaguauuguuguguuuuguggcaccucagguacauauggaacaggcucauggccugauggagcggauaucaaucucaugccuauauaa

SEQ ID NO: 56815 - RNA, 1410 nt, Artificial Sequence
  neuraminidase__InfluenzaA__EPI642512
augaauccaaaucaaaagauaauaacaauuggcucuauuucucucaucauugccacaauaugcuuccuuaugcaaauugccauccuggugauuacuguaacacugcauuucaagcaacauaacugcgacuccuccccaaacaaccaaguaauguuuugugaaccaacaauaauagaaagaaacaaaacggagauuguguaucugaucaacaccacuguagagaaggaaauaugccccaaaccaacagaauacagaaauuggucaaagccucaauguaacauuacaggauuugcaccuuuuucuaaggacaauucgauucggcuuucugcugguggggacaucugggugacaagagaaccuuaugugucaugcgaucccgacaaguguuaucaauuugcccuugggcagggaacaacacuaaacaacgggcauucaaaugacacuguacaugauaggaccccuuaccgaacccuauugaugaaugaauuggguguuccauuucauuugggaaccaggcaagugugcauagcaugguccaguucaaguugucacgaugggaaagcauggcugcauguuuguauaacuggagaugauggaaaugcaaccgcuagcuucauuuacaaugggaggcuaguagauaguauugguucaugguccaaaaauauacuaagaacccaggagucggaaugcguuuguauuaauggaacuuguacaguagucaugacugauggaagcgcguccggaaaagcugauacuaaaauauuauucauugaggaggggaaaaucauucauauuagcacguugucaggaagugcgcagcacgucgaggagugcucuuguuauccucgauauccuggugucagaugcgucugcagagacaacuggaaaggcuccaauagacccauaguugauauaaauguaaaggauuauagcauuguuuccaguuauguaugcucuggacuuguuggagacacacccagaaaaaacgacagcuucagcaguagucauugccuagauccuaacaaugaggaagguggucauggggugaaaggcugggccuuugaugauggaaaugacguguggaugggaagaacgaucagcgagaagucacgcuuaggcuaugaaaccuucaaagucgucaaaggaugguccgaacccaacuccaaauuacagacaaauaggcaaguuauaguugguagagguaacagguccgguuauucugguauuuucuccauugaaggcaaaaacuguaucaauaggugcuuuuauguggaguugauaaggggaaggaaagaggaaacuaaagucugguggaccucaaacaguauuguuguguuuugugguaccucagguacguauggaacaggcucauggccugauggggcggauaucaaucucaugccuauauaa

SEQ ID NO: 56816 - RNA, 1410 nt, Artificial Sequence
  neuraminidase__InfluenzaA__AIE52540
augaauccaaaucaaaagauaauaacaauuggcucuguuucucucauuauugccacaauaugcuuccucaugcaaauugccauccugguaacgacuguaacauugcauuucaagcaacaugacuacaacucccccccaaacaaccaaguaaugcugugugaaccaacaauaauagaaagaaacacaacagagauuguguaucugaccaacaucaccauagagaaggaaauaugccccaagcuagcagaauacagaaauuggucaaagccgcaauguaacauuacaggauuugcaccuuuuucuaaggacaauucuauccggcuuuccgcugguggggacaucugggugacaagagaaccuuaugugucaugcgauccugacaaguguuaucaauuugcucuuggacagggaacaacauugaacaacaggcauucaaauaacacuguacaugauagguccccuuaccgaacccuauugaugaaugaauuggguguuccauuucauuugggaaccaggcaagugugcauagcaugguccagcucaagcugucacgaugggaaagcauggcugcauguuuguaucaccggggaugacaacaaugcaacugcuaguuucauuuacaaugggaggcuuguagauaguauugguucaugguccaaaaauauacucagaacccaggaaucggaaugcguuuguaucaaugggacuuguacaguaguaaugacugaugggagugcuucagggaaagcugauacuaaaauacuauucauugaggaggggaagaucguucauauuagcacauugucaggaagugcucagcaugucgaggagugcuccuguuauccucgauauccuggugucagaugugucugcagagacaacuggaaaggcuccaauaggcccaucguagauauaaauaugaaggauuauagcauugcuuccaguuauguaugcucaggacuuguuggagacacacccagaaaaaacgacagcuucagcaguagccauugucuagauccuaacaaugagaaagguggucauggggugaaaggcugggccuuugaugauggaaaugacguguggaugggaaggacgaucagcgaggaguuucgcuuagguuaugaaaccuucaaggucaucaaaggcugguccaacccuaauuccaaauuacagacaaauaggcaagucauaguugaaaaagguaacagguccgguuacucugguguuuucuccauugaagacaaaagcugcaucaaucggugcuuuuauguggaguugauaaggggaagaaaagaggaaaccaaagucugguggaccucaaacaguauuguuguguuuuguggcacuucagguacauauggaacaggcucauggccugauggggcggauaucaaucucaugccuauauaa

SEQ ID NO: 56817 - RNA, 1410 nt, Artificial Sequence; identical to SEQ ID NO: 56816
  neuraminidase__InfluenzaA__EPI465399

SEQ ID NO: 56818 - RNA, 1410 nt, Artificial Sequence; identical to SEQ ID NO: 56816
  neuraminidase__InfluenzaA__EPI328899

SEQ ID NO: 56819 - RNA, 1410 nt, Artificial Sequence; identical to SEQ ID NO: 56816
  neuraminidase__InfluenzaA__EPI328901

SEQ ID NO: 56820 - RNA, 1410 nt, Artificial Sequence
  neuraminidase__InfluenzaA__EPI574645
augaauccaaaucaaaagauaauaacgauuggcucugucucucucaccauuuccacaauaugcuucuucaugcaaauugccaucuugauaacuacuguaacauugcauuucaagcaauaugaauucaacucccccccaaacaaccaaguggugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgggcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauucucaggacccaggagucagaaugcguuuguaucaauggaacuuguacaguaguaaugacugauggaagugcuucaggaaaagcugauacuaaaauacuauucauugaggagggaaaaaucauucauacuagcacauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacaccuagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaaccccaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaaaugaagucuuguggaccucaaacaguauuguuguguuuuguggcaccucagguacauauggaacaggcucauggccugauggggcggaccucaaucucaugccuauauaa

SEQ ID NO: 56821 - RNA, 1410 nt, Artificial Sequence
  neuraminidase__InfluenzaA__EPI563214
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguagcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcguuuguaucaauggaacuuguacaguaguaaugacugauggaagugcuucaggaaaagcugauacuaaaauacuauucauugaggaggggaaaaucguuuauacuagcaaauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggauggggagaacaaucaacgagacgucacgcuuaggguaugaaaccuucaaagucguugaaggcugguccaaccccaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56822 - RNA, 1410 nt, Artificial Sequence; identical to SEQ ID NO: 56821
  neuraminidase__InfluenzaA__EPI553998

SEQ ID NO: 56823 - RNA, 1410 nt, Artificial Sequence
  neuraminidase__InfluenzaA__EPI551568
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguagcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacauaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcguuuguaucaauggaacuuguacaguaguaaugacugauggaagugcuucaggaaaagcugauacuaaaauacuauucauugaggaggggaaaaucguuuauacuagcaaauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggauggggagaacaaucaacgagacgucacgcuuaggguaugaaaccuucaaagucguugaaggcugguccaaccccaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56824 - RNA, 1410 nt, Artificial Sequence
  neuraminidase__InfluenzaA__EPI629737
augaauccaaaucaaaagauaauagcgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaaccagcagaauacagaaauuggucaaaaccgcaauguagcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcguuuguaucaauggaacuuguacaguaguaaugacugauggaagugcuucaggaaaagcugauacuaaaauacuauucauugaggaggggaaaaucguuuauacuagcaaauugucaggaagugcucagcaugucgaagagugcucuugcuauccucgauauccuggugucagaugugucugcagagacaacuggaaaggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggauggggagaacaaucaacgagacgucacgcuuaggguaugaaaccuucaaagucguugaaggcugguccaaccccaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56825 - RNA, 1410 nt, Artificial Sequence; identical to SEQ ID NO: 56821
  neuraminidase__InfluenzaA__EPI631886

SEQ ID NO: 56826 - RNA, 1410 nt, Artificial Sequence; identical to SEQ ID NO: 56821
  neuraminidase__InfluenzaA__EPI577025

SEQ ID NO: 56827 - RNA, 1410 nt, Artificial Sequence; identical to SEQ ID NO: 54375
  neuraminidase__InfluenzaA__EPI404926

SEQ ID NO: 56828 - RNA, 1410 nt, Artificial Sequence; identical to SEQ ID NO: 54375
  neuraminidase__InfluenzaA__EPI492687

SEQ ID NO: 56829 - RNA, 1410 nt, Artificial Sequence
  neuraminidase__InfluenzaA__EPI530648
augaauccaaaucaaaagauaauaacgauuggcucuguuucucucaccauuuccacaauaugcuuuuucaugcaaauugccauuuugauaacuacuguaacauugcauuucaagcaauaugaauucaacucccccccaaacaaccaagugaugcugugugaaccaacaauaauagaaagaaacauaacagagauaguguauuuaaccaacaccaccauagagaaggaaauaugccccaaaccagcagaauacagaaauuggucaaaaccgcaauguggcauuacaggauuugcaccuuucucuaaggacaauucgaucaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaagggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagacaaauaggcaagucauaguugacagaggugauagguccgguuauucugguauuuucucuguugaaggcaaaagcugcauaaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56830 - RNA, 1410 nt, Artificial Sequence; identical to SEQ ID NO: 56811
  neuraminidase__InfluenzaA__EPI684314

SEQ ID NO: 56831 - RNA, 1410 nt, Artificial Sequence
  neuraminidase__InfluenzaA__EPI614459
augaauccaaaucaaaagauaauaacgauuggcucuguuucucucaccauuuccacaauaugcuuuuucaugcaaauugccauuuugauaacuacuguaacauugcauuucaagcaauauaaauucaacucccccccaaacaaccaagugaugcugugugaaccaacaauaauagaaagaaacauaacagagauaguguauuuaaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaagggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagacaaauaggcaagucauaguugacagaggugauagguccgguuauucugguauuuucucuguugaaggcaaaagcugcauaaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56832 - RNA, 1410 nt, Artificial Sequence; identical to SEQ ID NO: 56831
  neuraminidase__InfluenzaA__EPI541466

SEQ ID NO: 56833 - RNA, 1410 nt, Artificial Sequence; identical to SEQ ID NO: 56831
  neuraminidase__InfluenzaA__EPI696968

SEQ ID NO: 56834 - RNA, 1410 nt, Artificial Sequence; identical to SEQ ID NO: 56831
  neuraminidase__InfluenzaA__EPI674598

SEQ ID NO: 56835 - RNA, 1410 nt, Artificial Sequence
  neuraminidase__InfluenzaA__EPI530678
augaauccaaaucaaaagauaauaacgauuggcucuguuucucucaccauuuccacaauaugcuuuuucaugcaaauugccauuuugauaacuacuguaacauugcauuucaagcaauaugaauucaacucccccccaaacaaccaagugaugcugugugaaccaacaauaauagaaagaaacauaacagagauaguguauuuaaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagcgcucagcaugucgaagagugcucuugcuauccucgauauccuggugucagaugugucugcagagacaacuggaagggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagacaaauaggcaagucauaguugacagaggugauagguccgguuauucugguauuuucucuguugaaggcaaaagcugcauaaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56836 - RNA, 1410 nt, Artificial Sequence
  neuraminidase__InfluenzaA__EPI530680
augaauccaaaucaaaagauaauaacgauuggcucuguuucucucaccauuuccacaauaugcuuuuucaugcaaauugccauuuugauaacuacuguaacauugcauuucaagcaauaugaauucaacucccccccaaacaaccaagugaugcugugugaaccaacaauaauagaaagaaacauaacagagauaguguauuuaaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagauauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagcgcucagcaugucgaagagugcucuugcuauccucgauauccuggugucagaugugucugcagagacaacuggaagggcuccaaucggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaauggcguguggaugggaagaacaaucaacgagacgucacgcuuaggguaugaaaccuucaaagucauugaaggcugguccaacccuaaguccaaauugcagacaaauaggcaagucauaguugacagaggugauagguccgguuauucugguauuuucucuguugaaggcaaaagcugcauaaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56837 - RNA, 1410 nt, Artificial Sequence; identical to SEQ ID NO: 44542
  neuraminidase__InfluenzaA__EPI7603

SEQ ID NO: 56838 - RNA, 1410 nt, Artificial Sequence; identical to SEQ ID NO: 56829
  neuraminidase__InfluenzaA__EPI814527

SEQ ID NO: 56839 - RNA, 1410 nt, Artificial Sequence; identical to SEQ ID NO: 56829
  neuraminidase__InfluenzaA__EPI674737

SEQ ID NO: 56840 - RNA, 1410 nt, Artificial Sequence; identical to SEQ ID NO: 56829
  neuraminidase__InfluenzaA__EPI614443

SEQ ID NO: 56841 - RNA, 1410 nt, Artificial Sequence; identical to SEQ ID NO: 56829
  neuraminidase__InfluenzaA__EPI551812

SEQ ID NO: 56842 - RNA, 1410 nt, Artificial Sequence; identical to SEQ ID NO: 56829
  neuraminidase__InfluenzaA__EPI696961

SEQ ID NO: 56843 - RNA, 1410 nt, Artificial Sequence; identical to SEQ ID NO: 56829
  neuraminidase__InfluenzaA__EPI740789

SEQ ID NO: 56844 - RNA, 1410 nt, Artificial Sequence
  neuraminidase__InfluenzaA__EPI377498
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacaugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 56845 - RNA, 1410 nt, Artificial Sequence; identical to SEQ ID NO: 56844
  neuraminidase__InfluenzaA__EPI377498

SEQ ID NO: 56846 - RNA, 1410 nt, Artificial Sequence; identical to SEQ ID NO: 56844
  neuraminidase__InfluenzaA__EPI391246

SEQ ID NO: 56847 - RNA, 1410 nt, Artificial Sequence; identical to SEQ ID NO: 56844
  neuraminidase__InfluenzaA__EPI407122

SEQ ID NO: 56848 - RNA, 1410 nt, Artificial Sequence; identical to SEQ ID NO: 56844
  neuraminidase__InfluenzaA__EPI407125

SEQ ID NO: 56849 - RNA, 1410 nt, Artificial Sequence; identical to SEQ ID NO: 56811
  neuraminidase__InfluenzaA__EPI562038

SEQ ID NO: 56850 - RNA, 1410 nt, Artificial Sequence; identical to SEQ ID NO: 56811
  neuraminidase__InfluenzaA__EPI562038

SEQ ID NO: 56851 - RNA, 1410 nt, Artificial Sequence; identical to SEQ ID NO: 53121
  neuraminidase__InfluenzaA__EU716525

SEQ ID NO: 56852 - RNA, 1350 nt, Artificial Sequence
  neuraminidase__InfluenzaA__EPI232422
augaauccaaaucagaagauaauaaccaucggaucaaucuguaugguaauuggaauaguuagcuuaauguuacaaauugggaacaugaucucaauaugggucagucauucaauucagacagggaaucaacgccaagcugaaccaaucagcaauacuaaauuucuuacugagaaagcuguggcuucaguaacauuagcgggcaauucaucucuuugccccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggagaaccaaaagcacuaauuccaggagcggcuuugaaaugauuugggauccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccagugggagcagcauaucuuuuugugguguaaauagugacacuguuaguuggucuuggccagacggugcugaguugccauucaccauugacaaguag

SEQ ID NO: 56853 - RNA, 1350 nt, Artificial Sequence
  neuraminidase__InfluenzaA__EPI227593
augaauccaaaucagaagauaauaaccaucggaucaaucuguaugguaauuggaauaguuagcuuaauguuacaaauugggaacaugaucucaauaugggucagucauucaauucagacagggaaucaacgccaagcugaaccaaucagcaauacuaaauuucuuacugagaaagcuguggcuucaguaacauuagcgggcaauucaucucuuugccccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagauaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaauggugucuggaucgggagaaccaaaagcacuaauuccaggagcggcuuugaaaugauuugggauccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccagugggagcagcauaucuuuuugugguguaaauagugacacuguuaguuggucuuggccagacggugcugaguugccauucaccauugacaaguag

SEQ ID NO: 56854 - RNA, 1350 nt, Artificial Sequence
  neuraminidase__InfluenzaA__EPI435658
augaauccaaaucagaagauaguaaccauuggaucaaucuguaugguaauuggaauaauuagcuugauguuacagauugggaacauaaucucaauaugggucagucauucaauucaaacagggaaucaacaccaaacugaaccaaucagaaauacuaauuuucuuacugagaacgcuguagcuucaguaacauuagcuggcaauucaucucuuugccccauuagaggaugggcuguacacaguaaagacaacaguauaaggauuggguccaagggggauguguuuguaauuagagagccguucaucucaugcucccaucuggaaugcagaacuuucuuuuugacucagggagcuuuacugaaugacaagcacuccaacgggacugucaaagauaggagcccucacagaacgcuaaugaguuguccuauaggugaggcucccuccccauauaacucgagguuugagucuguugcuuggucggcaagugcuugccaugauggcaccaguugguugauaauuggaauuucugguccagacaauggggcuguggcgguauugaaauacaauggcauaauaacagacacuaucaagaguuggaggaauaacauacugaggacccaagagucugaaugugcauguguaaauggcucuugcuuuacugugaugacagauggaccaaguaaugggcaggcaucauauaagauuuucaaaauagaaaaagggaaaguaguuaagucagucgaauugaaugcuccuaauuaucacuaugaggaaugcuccuguuauccugaugcuggcgaaaucauaugugugugcagggauaauuggcauggcucaaacaggccauggguaucuuucaaucagaauuuggaguaucaaauaggauauauuugcaguggaguuuucggagacaauccacggccaaaugacgggacagguaguugugguccaguguccccuaacggggcauaugggguaaaaggguucucauuuaaauacggcaauggugucuggaucgggaggaccaaaagcacucauuccaggagcggcuuugaaaugauuugggauccaaacggguggacuggaacggacagugaauuuucgaugaaacaagauauaguagcaauaacugauuggucaggauauagcgggaguuuuguccagcacccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 56855 - RNA, 1350 nt, Artificial Sequence; identical to SEQ ID NO: 56854
  neuraminidase__InfluenzaA__EPI492513

SEQ ID NO: 56856 - RNA, 1350 nt, Artificial Sequence
  neuraminidase__InfluenzaA__EPI165066
augaauccaaaucagaagauaauaaccaucggaucaaucuguaugguaacuggaauaguuagcuuaauguuacaaguugggagcaugaucucaauaugggucagucauucaauucacacagggaaucagcaccaagcugagccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccuaugggugaggcucccuccccauacaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaauggucaggcaucacauaagaucuucaaaauggaaaaaggaaaagugauuaaaucagucgaauuggaugcuccuaauuaucacuaugaggaaugcuccuguuauccugaugccggcgaaaucacgugugugugcagggauaauuggcauggcucaaaucggccauggguaucuuucaaucaaaacuuggaguaucaaauaggauauauaugcagugggguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagauuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 56857 - RNA, 1350 nt, Artificial Sequence
  neuraminidase__InfluenzaA__EPI531308
augaauccaaaucagaagaucauaaccaucggaucaaucuguaugguaacuggaguaguuagcuuaauguuacaaguugggaacaugaucucgauauggaucagucauucaauucacacagggaaucaacaccaagcugagccaaucagcaauacuaauuuccauacugagaaagcuguggucucagcuaaauuagcgggcaacucaucucuuugccccauuaacggaugggcuguauacagcaaggacaacagcauaaggaucgguuccaaaggggauguguuuguuauaagagagccauucaucucaugcucucacuuggaaugcagaacuuucuuuuugacucaaggagcuuugcugaaugauaaacacuccaaugggacugccaaagacagaagcccucacaggacauuaaugaguuguccugugggugaggcucccuccccguauaacucaagguuugagucuguugcuuggucagcaagugcuugccaugauggcaccaguugguugacaauuggaauuucuggcccagacaauggggcuguggcgguauugaaauacaauggcauaauaacagacacuaucaagaguuggaggaacaacguacugagaacucaagagucugaaugugcauguguaaaugguuauugcuuuacuguaaugacagauggaccaaguaauggucaggcaucacauaagaucuucaaaauggaaaaagggaaaguaauuaaaucagucgaauuggaugcuccuaauuaucacuaugaggaaugcuccuguuauccugaugccggcgaaaucacauguguaugcagggauaauuggcaugguucaaaucgaccauggauaucuuucaaccaaaacuuggaguaucaaauaggauauauaugcagugggguuuucggagacaauccacgccccaaugauggaaaagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacagacaguagcuucucagugaaacaagauauuguagcaauaacugauuggucaggguacagcgggaguuuuguccagcauccagaacugacaggacuagauugcauaagaccuuguuucuggguugaguugaucagagggcggcccaaagagggcacaaucuggacuagugggagcagcauaucuuucuguggugugaguggugacacuguggguuggucuuggccagacggugcugaguugccauucaccauugacaaguag

SEQ ID NO: 56858 - RNA, 1350 nt, Artificial Sequence
  neuraminidase__InfluenzaA__EPI433308
augaauccaaaccaaaagauaauaaccauugggucaaucuguaugguaauuggaauaguuagcuuaauguuacaaauugggaacuugaucucaauaugggucagucauucaauucagagagggaaucuaaaccaaguugaaccaaucagcaauacuaguuuuccuacugagaaggcuguggcuucaguaacauuagcgggcaauucaucucuuugcccuauuagagguugggcuguacacaguaaagacaacaguauaaggauugguuccaagggggauguguuuguuauuagagagccauucaucucaugcucccauuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguugcuguagugaaauacaauggcauaauaacagacaccaucaagaguugggggaacaacauacugagaacucaagagucugaaugugcauguguaaauggcucuugcuuuacuguaaugacugacggaccaaguaaugggcaggcaucauauaagaucuucaaaauggaaaaaggaaaaguaauuaaaucagucgaauuggaugcuccuaauuaccacuaugaggaaugcuccuguuacccugaugccggcgaaaucacaugugugugcagggauaauuggcaugguucaaaucggccauggguguccuucaaucaaaaucuggaguaucaaauaggauauauaugcaguggaguuuucggagacaauccacgccccaaugauggaacagguaguugugguccgguguccccuaauggggcauaugggguaaagggguuuucauuuaaauacggcaauggcguuuggaucggaagaaccaaaagcccuaauuccaggagcggcuuugaaaugauuugggauccaaauggauggagugaaacggacaguagcuucucggugaaacaagauauauuagcaguaacugauuggucaggauauagcgggaguuuuguccagcauccagaacugacagguuuagauugcauaagaccuuguuucuggguugaguuaaucagagggcggccugaagagaguacaaucuggacuagugggagcagcauauccuuuugugguguaaauagugacacugugaguuggucuuggccagacggugcugaguugccauucaccauugacaaguaa

SEQ ID NO: 56859 - RNA, 1350 nt, Artificial Sequence
  neuraminidase__InfluenzaA__EPI114974
augaauccaaaucagaagauaauaaccaucggaucaaucuguaugguaauuggaauaguuagcuuaauguuacaaauugggaacaugaucucaauaugggucagucauucaauucagacagggaaucaacgccaagcugaaccaaucagcaauacuaaauuucuuacugagaaagcuguggcuucaguaacauuagcgggcaauucaucucuuugccccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugaccauuggaauuucugguccagacaauggggcuguggcuguauugaaauacaauggcauaauaacagacaccaucaagaguuggaggaacaacauacugagaacccaagagucugaaugugcauguguaaauggcucuugcuuuacuguaaugacugauggaccaaguaaugggcaggcaucauauaagaucuucaaaauggaaaaagggaaagugguuaaaucaaucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggauugggagaaccaaaagcacuaauuccaggagcggcuuugaaaugauuugggauccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcaccauuuggaccagugggagcagcauaucuuuuugugguguaaauagugacacuguuaguuggucuuggccagacggugcugaguugccauucaccauugacaaguag

SEQ ID NO: 56860 - RNA, 1350 nt, Artificial Sequence
  neuraminidase__InfluenzaA__EPI622495
augaauccaaaucagaagauaacaaccaucggaucaaucuguaugguaauuggaauaguuagcuuaauguuacaaauugggaacauggucucaauauggguuagucauucaauucagacuaggaaucaacgccaagcugaaccgaucagcaacacuagaucucuuacugagaaagcuguggcuucaguaacauuagcgggcaauucaucucuuugccccauuagcggaugggcuguauacaguaaggacaacagcauaaggaucgguuccaagggggauguguuuguuauaagagagccguucaucucaugcucacacuuggaaugcagaacuuucuuuuugacucagggagcuuugcuaaaugacaagcacuccaaugggacagucaaagacagaagcccucacagaacauuaaugaguugcccugugggugaggcucccuccccuuauaacucaagguuugagucuguugcuuggucagcaagugcuugccaugauggcaccaguugguugacaauuggaauuucuggcccagauaauggggccguggcaguagugaaauacaauggcauaauaacagacacuaucaagaguuggagaaacaacauacugagaacucaagagucugaauguguauguguaaauggcucuugcuuuacuguaaugacugauggaccaaguaauaagcaggcaucauauaagauuuucaaaauggaaaaaggaaaagugguuaaaucaaucgaauuggaugcuccuaauuaucacuaugaggagugcuccuguuauccugaugccggcgaaaucacaugugugugcagagauaauuggcauggcucaaauaggccaugguuaucuuucaaucaaaauuuggaguaucaaauaggguauauaugcaguggaguuuucggagacaauccacgccccaaugauggaacagguaguugugguccgguguccucuaacggggcauaugggguaaaaggguuuucauuuaaauacggcaaugguguuuggaucgggagaaccaaaagcacuaauuccaggagcgguuuugaaaugauuugggauccaaauggguggacuggaacggacagcagcuuuucgaugaagcaagauaucguggcaauaacugauuggucaggauauagcgggaguuuuguccagcauccagaacugacaggauuagauugcauaagaccuuguuuuuggguugaguuggucagagggcggcccaaagagggcacaaucuggacuagugggagcagcauauccuuuugugguguaaauagugacacugugaguuggucuuggccagacggugcugaguugccauucaccauugacaaguag

SEQ ID NO: 56861 - RNA, 1350 nt, Artificial Sequence
  neuraminidase__InfluenzaA__EPI349847
augaauccaaaucagaagauaacaaccaucggaucaaucuguaugguaauuggaauaguuagcuuaauguuacaaauugggaacauggucucaauauggguuagucauucaauucagacuaggaaucaacgccaagcugaaccgaucagcaacacuagaucucuuacugagaaagcuguggcuucaguaacauuagcgggcaauucaucucuuugccccauuagcggaugggcuguauacaguaaggacaacagcauaaggaucgguuccaagggggauguguuuguuauaagagagccguucaucucaugcucacacuuggaaugcagaacuuucuuuuugacucagggagcuuugcuaaaugacaagcacuccaaugggacagucaaagacagaagcccucacagaacauuaaugaguugcccugugggugaggcucccuccccuuauaacucaagguuugagucuguugcuuggucagcaagugcuugccaugauggcaccaguugguugacaauuggaauuucuggcccagauaauggggccguggcaguagugaaauacaauggcauaauaacagacacuaucaagaguuggagaaacaacauacugagaacucaagagucugaauguguauguguaaauggcucuugcuuuacuguaaugacugauggaccaaguaauaagcaggcaucauauaagauuuucaaaauggaaaaaggaaaagugguuaaaucaaucgaauuggaugcuccuaauuaucacuaugaggagugcuccuguuauccugaugccggcgaaaucacaugugugugcagagauaauuggcauggcucaaauaggccaugguuaucuuucaaucaaaauuuggaguaucaaauaggguauauaugcaguggaguuuucggagacaauccacgccccaaugauggaacagguaguugugguccggugucccauaacggggcauaugggguaaaaggguuuucauuuaaauacggcaaugguguuuggaucgggagaaccaaaagcacuaauuccaggagcgguuuugaaaugauuugggauccaaauggguggacuggaacggacagcagcuuuucgaugaagcaagauaucguggcaauaacugauuggucaggauauagcgggaguuuuguccagcauccagaacugacaggauuagauugcauaagaccuuguuuuuggguugaguuggucagagggcggcccaaagagggcacaaucuggacuagugggagcagcauauccuuuugugguguaaauagugacacugugaguuggucuuggccagacggugcugaguugccauucaccauugacaaguaa

SEQ ID NO: 56862 - RNA, 1350 nt, Artificial Sequence
  neuraminidase__InfluenzaA__EPI174804
augaauccaaaucagaagauaauaaccaucggaucaaucuguaugguaauuggaauaguuagcuuaauguuacaaauugggaacauggucucaauaugggucagucauucaauucagacuaggaaucaacgccaagcugaaccgaucagcaacacuaaaucucuuacugagaaagcuguggcuucaguaacauuagcgggcaauucaucucuuugccccauuagcggaugggcuguauacaguaaggacaacagcauaaggaucgguuccaagggggauguguuuguuauaagagagccguucaucucaugcucacacuuggaaugcagaacuuucuuuuugacucagggagcuuugcuaaaugacaagcacuccaaugggacaaucaaagacagaaguccucacagaacauuaaugaguuguccugugggugaggcucccuccccuuauaacucaagguuugagucugucgcuuggucagcaagugcuugccaugauggcaccaguugguugacaauuggaauuucuggcccagauaauggggcuguggcuguauugaaauacaauggcauaauaacagacacuaucaagaguuggagaaacaacauacugagaacucaagagucugaaugugcauguguaaauggcucuugcuuugcuguaaugacugauggaccaaguaauaggcaggcaucauauaagauuuucaaaauggaaaaaggaaaagugguuaaaucaaucgaauuggaugcuccuaauuaucacuaugaggagugcuccuguuauccugaugccggcgaaaucacaugugugugcagagauaauuggcauggcucaaauaggccaugguuaucuuucaaucaaaauuuggaguaucaaauaggguauauaugcaguggaguuuuuggagacaauccacgccccaaugauggaacagguaguugugguccgguguccucuaacggggcauaugggguaaaaggguuuucauuuaaauacggcaaugguguuuggaucgggagaaccaaaagcacuaauuccaggagcgguuuugaaaugauuugggauccaaauggguggacugaaacggacagcagcuuuucgaugaagcaagauaucguagcaauaacugauuggucaggauauagcgggaguuuuguucagcauccagaacugacaggauuagauugcauaagaccuuguuucuggguugaguuggucagagggcggcccaaagagagcacaaucuggacuagugggagcagcauaucuuuuugugguguaaauagugacacugugaguuggucuuggccagacggugcugaguugccauucaccauugacaaguag

SEQ ID NO: 56863 - RNA, 1350 nt, Artificial Sequence
  neuraminidase__InfluenzaA__EPI492441
augaauccaaaucaaaagauaauggccauuggaucagucuguaugguaauuggaauaguuagcuuaauguuacagauugggaacacaaucucaauaugggucagucauucauuucaaacaagaguccaacaccaagcugaaccaaucagaaacacuaacuuucuuacugagaacgcuguggcuucaguaacauuagcgggcaauucgucucuuugccccauuagggggugggcuguacacagcaaggacaacaguauaagaauugguuccaagggggauguguuuguaauuagagagccguucaucucaugcucucauuuggagugcagaacuuucuuuuugacccagggagccuuacuaaaugacaagcacuccaacaggacugucaaagacaggagcccucacagaacacuaaugaguugcccugugggugagguucccuccccauacaacucaagauuugagucuguugcuuggucagcaagugcuugccaugauggcaccaguugguugacaauuggaauuucaggaccagacaauggggcuguggcuguauugaaauacaauggcauaauaacagacaccaucaagaguuggaggaacaacauacugagaacucaagaguccgaaugugcauguguaaaugguuuuugcuuuacugugaugaccgauggaccaaguaauggacaggcaucauauaagaucuucaaaaugaaaaaagggaaaguaguuaaaucagucgaguugaaugcuccuaauuaucacuaugaggaaugcuccuguuauccugaugcgggagaaaucaugugugugugcagggauaacuggcaugguucaaauagaccaugggugucuuucaaucagaauuuggaguaucagauaggguauauaugcaguggaguuuucggagacaauccacgcccaaaugauggaacagguaguuguggcccaguuuccccuaacggggcauaugggauaaaaggguucucauuuaaauacggcaauggcguuuggaucgggagaaccaaaagcacuaauuccagaagcggcuuugaaaugguuugggauccaaauggguggacugauacggacagugacuuuucgauaaaacaagauauaguagcaauaacugauuggucaggauauagcgggaguuuuguccagcauccagaacugacaggauuagauugcauaagaccuugcuucuggguugaguuaaucagagggcgucccaaagaaagcacaauuuggacuagugggagcagcauauccuuuugugguguaaauagugaaacugugaguuggucuuggccagacggugcugaguugccauucaccauugacaaguag

SEQ ID NO: 56864 - RNA, 1350 nt, Artificial Sequence
  neuraminidase__InfluenzaA__EPI164142
augaauccaaaucagaagauaauaaccauugggucaaucuguaugguaauuggaauaguuagcuuaauguuacaaauugggaacaugaucucaauaugggucagucauucaauucaaacagggaaucaacaccaagcugaaccaaucagaaaugcuaauuuucuuacugagaacgcuguggcuucaguaacauuagcgggcaauucaucucuuugucccguuagaggaugggcuguacacaguaaagacaacaguauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacaccaucaagaguuggaggaacaacauacugaggacucaagagucugaaugugcauguguaaauggcucuugcuuuacuguaaugacugauggaccaaguaaugggcaggcaucauauaagaucuucaaaauggaaaaagggaaaguggucaaaucagucgaauugaaugcuccuaauuaucacuaugaggaaugcuccuguuauccugaugcuggcgaaaucacaugugugugcagggauaauuggcauggcucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucggaagaaccaaaagcacuaauuccaggagcggcuuugaaaugauuugggauccaaauggguggacugaaacggacaguaacuuuucggugaaacaagauauaguagcaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguaa

SEQ ID NO: 56865 - RNA, 1350 nt, Artificial Sequence
  neuraminidase__InfluenzaA__EPI827076
augaauccaaaucagaagauaguaaccauuggaucaaucuguaugguaauuggaauaauuagcuugauguuacagauugggaacauaauaucaauaugggucagucauucaauucaaacagggaaucaacaccaaacugaaccaaucagaaauacuaauuuucuuacugagaacgcuguagcuucaguaacauuagcuggcaauucaucucuuugccccauuaaaggaugggcuguacacaguaaagacaacaguauaaggauuggguccaagggggauguguuuguaauuagagagccguucauaucaugcucccaucuggaaugcagaacuuucuuuuugacucagggagcuuuacugaaugacaagcacuccaacgggacugucaaagauaggagcccucacagaacgcuaaugaguugcccuauaggugaggcucccuccccauauaacucaagguuugagucuguugcuuggucggcaagugcuugccaugauggcaccaguugguugauaauuggaauuucugguccagacaauggggcuguggcgguauugaaauacaauggcauaauaacagacacuaucaagaguuggaggaauaacauacugaggacccaagagucugaaugugcauguguaaauggcucuugcuuugcuguuaugacagauggaccaaguaaugggcaggcaucauauaagauuuucaaaauagaaaaagggaaaguaguuaagucagucgaauugaaugccccuaauuaucacuaugaggaaugcuccuguuauccugaugcuggcgaaaucauaugugugugcagggauaauuggcauggcucaaacaggccauggguaucuuucaaucagaauuuggaguaucaaauaggauauauuugcaguggaguuuucggugacaauccacggccaaaugacgguacagguaguugugguccaguguccucuaacggggcauaugggguaaaaggguucucauuuaaauauggcaauggugucuggaucgggaggaccaaaagcacucauuccaggagcggcuuugaaaugauuugggauccaaacggguggacuggaacggacagugaauuuucgaugaaacaagauauaguagcaauaacugauuggucaggauauagcgggaguuuuguccagcacccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 56866 - RNA, 1350 nt, Artificial Sequence; identical to SEQ ID NO: 47083
  neuraminidase__InfluenzaA__EPI168491

SEQ ID NO: 56867 - RNA, 1350 nt, Artificial Sequence
  neuraminidase__InfluenzaA__EPI827078
augaauccaaaucagaagauaauaaccaucggaucaaucuguaugguaauugggauagcuagcuuaauguuacaaauuggaaacauaaucucaauauggaucagucauucaauucagacagggaaccaaugucaaaaugaaucaaucagcaacacuaaauuucuugcugagaaagcuguggcuucaguaacauuagcgggcaauucaucucuuugucccguuagcggaugggcuguguacaguaaagauaacagcauaaggaucgguuccaagggggauguguuuguuauaagagagccauucaucucaugcucccacuuggaaugcagaacuuucuuuuuaacccagggagccuuacugaaugacaagcacuccaauggaacugucaaagacagaagcccucacagaacauuaaugaguuguccggugggugaggcucccuccccauacaacucaagguuugagucuguugcuuggucagcaagcgcuugccaugauggcaccaguugguugacaauuggaauuucugguccagacaguggggcuguggcuguauugaaauacaauggcauaauaacagacaccaucaagagcuggaggaacaacauaaugagaacucaagagucugaaugugcauguguaaauggcucuugcuuuacuauaaugacugauggaccaaguaguggccaggcaucauauaagaucuucaaaauggaaaagggaaaagugauuaaaucagucgaauuggaugcuccuaauuaucacuaugaggagugcuccuguuauccugaugccggcgaaaucacaugugugugcagggauaauuggcauggaucaaacaggccauggauaucuuucaaucaaaauuuggaguaucaaauaggauauauaugcaguggaguuuucggagacaauccacgccccaaugauggaacggguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugaauggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugggguaaauggugacacuguuaguuggucuuggccagacggugcugaguugccauucaccauugacaaguag

SEQ ID NO: 56868 - RNA, 1350 nt, Artificial Sequence
  neuraminidase__InfluenzaA__EPI594521
augaauccaaaucagaagauaauaaccaucggaucaaucugugugggaauuggaauagucagcuuaauguuacaaauugggaacauggucucaauaugggucaaucauucaauucagacagagaaucagugccaagcugaaucaaucagcaauacuaaauuucucacugagaaggcuguggcuccaguaacauuaauggguaauucaucucuuugccccauuagcggaugggcuguacacaguaaggacaauagcauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagagcauuaaugaguuguccugugggugaagcucccucuccauauaacucaagguuugagucuguugcuuggucagcaagugccugccaugauggcaccgguugguuaacaauuggaauuucuggcccagacaauggggcuguggcuguauugaaauacaauggcauaauaacagacacuaucaaaaguuggaggaacaacauacugagaacucaagagucugaaugugcauguguaaauggcucuugcuuuacuguaaugacugauggaccaaguaaugggcaggcaucauauaaaaucuucaaauuggaaaaagggaaagugguuaaaucaguugaauuggaugcuccuaauuaucacuaugaggaaugcuccuguuauccugaugccggcgaaaucacuugugugugcagggauaauuggcaugguucaaauagaccauggguaucuuucaaccaaaauuuagaguaccaaauaggauauauaugcaguggaguuuucggagacaauccacggcccaaugauggaacagggagcugugguccggugucccccaauggggcauauggggugaaaggauuuucauuuaaauacgguaaugguguuuggaucgggagaaccaaaagcacuaauuccaggaguggcuuugaaaugauuugggauccgaauggguggacugaaacggacagcagcuucucggugaagcaagacaucguggcaauaacugauuggucaggauauagcgggaguuuuguccagcauccagaacugacaggauuagauugcauaagaccuuguuucuggguugaguuaauaagagggcggcccaaagagagcacaaucuggacuagugggagcagcauauccuuuugugguguaaauagugacacuguagguuggucuuggccagacggugcugaggugccauucaccauugacaaguag

SEQ ID NO: 56869 - RNA, 1410 nt, Artificial Sequence
  neuraminidase__InfluenzaA__EPI5787
augaauccaaaucagaagauaauaaccauuggaucaaucuguaugguaguugggauaauuagcuugauguuacaaauugggaacauaaucucaauaugggucagucauucaauucagacagggaaucaacaccaagcugaaccaugcaaucaaagcauuauuacuuaugaaaacaacaccuggguaaaucaaacauaugucaacaucagcaauaccaauuuucuuacugaaaaagcuguggcuucaguaacauuagcgggcaauucaucucuuugccccauuagcggaugggcuguacacaguaaggacaacgguauaagaaucgguuccaagggggauguguuuguuauaagagagccguucaucucaugcucccacuuggaaugcagaacuuucuuuuugacucagggagccuugcugaaugacaagcacuccaaugggaccgucaaagacagaagcccucacagaacauugaugaguuguccugugggugaggcucccuccccauauaacucaagguuugagucuguugcuuggucggcaagugcuugccaugauggcaccaguugguugacaauuggaauuucuggcccagacaauggggcuguggcuguauugaaauacaacggcauaauaacagacacuaucaagaguuggaggaacaacauacugagaacucaagagucugaaugugcauguguaaauggcucuugcuuuacuguaaugacugacggaccaaguaaugggcaggccucauauaagaucuucaaaauggaaaaagggaaaguaguuaaaucagucgaauugaaugccccuaauuaucacuaugaggagugcuccuguuauccugaugcuggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacaggcaguugugguccgguguccccuaacggggcauauggaguaaaaggguuuucauuuaaauacggcaaugguguuuggaucgggagaaccaaaagcacuaauuccaggagcggcuuugaaaugauuugggauccaaauggguggacuggaacggacaguagcuucucggugaaacaagauaucguagcaauaacugauuggucaggauauagcgggaguuuuguccagcauccagaacugacaggauuagauugcauaagaccuuguuucuggguugagcuaaucagagggcggcccaaagagagcacaauuuggacuagugggagcagcauaucuuuuugugguguaaauagugacacuguggguuggucuuggccagacgaugccgaguugccauucaccauugacaaguag

SEQ ID NO: 56870 - RNA, 1410 nt, Artificial Sequence; identical to SEQ ID NO: 56869
  neuraminidase__InfluenzaA__EPI5787

SEQ ID NO: 56871 - RNA, 1350 nt, Artificial Sequence
  neuraminidase__InfluenzaA__EPI267031
augaauccaaaucagaagauaguaaccauuggaucaaucuguaugguaauuggaauaguuagcuugauguuacagauugggaacaugaucucaauaugggucagucauucaauucaaacagggaaucaacaccaaacugaaccaaucagaaauacuaauuuucuuacugagaacacuguggcuucaguaacauuagcuggcaauucaucucuuugccccauuagaggaugggcuguacacaguaaagacaacaguauaaggauuggguccaaaggggauguguuuguaauuagagagccguucaucucaugcucccaucuggaaugcagaacuuucuuuuugacucagggagcuuuacuaaaugacaagcacuccaacgggacugucaaagacaggagcccucacagaacgcuaaugaguuguccuauaggugaggcucccuccccauauaacucgagguuugagucuguugcuuggucggcaagugcuugccaugauggcaccaguugguugacaauuggaauuucugguccagacaauggggcuguggcgguauugaaauacaauggcauaauaacagacacuaucaagaguuggaggaauaacauacugaggacccaagagucugaaugugcauguguaaauggcucuugcuuuacugugaugacagauggaccaaguaauggacaggcaucauauaagauuuucaaaauggaaaaagggaaaguaguuaagucagucgaauugaaugcuccuaauuaucacuaugaggaaugcuccuguuauccugaugcuggcgaaaucauaugugugugcagggauaauuggcauggcucaaacaggccauggguaucuuucaaucagaauuuggaguaucaaauaggauauauuugcaguggaguuuucggagacaauccacgaccaaaugaugggaaagguaguugugguccaguguccccuaacggggcauaugggguaaaaggguuuucauuuaaauacggcaauggugucuggaucgggaggaccaaaagcacucauuccaggagcggcuuugaaaugauuugggauccaaauggguggacuggaacggacagugaauuuucgaugaaacaagauauaguagcaauaacugauuggucaggauauagcgggaguuuuguccagcacccagaacugacaggauuagauugcauaagaccuugcuucugggucgaguuaaucagagggcggcccaaggagagcacaauuuggacuagugggagcagcauaucuuuuugugguguaaauagugacacugugaguuggucuuggccagacggugcugaguugccauucaccauugacaaguag

SEQ ID NO: 56872 - RNA, 1350 nt, Artificial Sequence; identical to SEQ ID NO: 53149
  neuraminidase__InfluenzaA__EPI376539

SEQ ID NO: 56873 - RNA, 1350 nt, Artificial Sequence
  neuraminidase__InfluenzaA__EPI124069
augaauccaaaucagaagauaauaaccauuggaucaaucuguaugguaauuggaauaguuagcuuaauguuacaaauugggaacaugaucucaauaugggucagucauucaauucagacagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguuccaagggggauguguuuguuauuagagagccguucaucucaugcucccaccuggaaugcagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugagaacucaagagucugaaugugcauguguaaauggcucuugcuuuacuguaaugacugauggaccaagugaugggcaggcaucauauaagaucuucaaaauggaaaaaggaaaaguggucaaaucagucgaauuggaugcuccuaauuaucacuaugaggaaugcuccuguuauccugaugccggcgaaaucacauguguuugcagggauaauuggcauggcucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaauuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 56874 - RNA, 1350 nt, Artificial Sequence
  neuraminidase__InfluenzaA__EPI342499
augaauccaaaucagaaaauaauaaccauuggaucaaucuguaugguaauuggaauaguuagcuuaauguuacaaauugggaacaugaucucaauauggaucagucauucaauucagaaagggaaucaacaccgaacugaaucaaucagcaauacuaacccucuuacugagaaagcuguggcuucaguaacauuaacgggcaauucaucucuuugccccauuagaggaugggcuguacacaguaaggacaacaauauaaggaucgguuccaagggggauguguuuguuauuagagagccguucaucucaugcucccaucuggaauguagaacuuucuucuugacacagggagccuuacugaaugacaagcacuccaacggaacugucaaagacagaagcccucacagaacauuaaugaguuguccuuugggugaggcucccucuccauauaacucaagguuugagucuguugcuuggucagcaagugcuugccaugauggcaccgguugguugacaauuggaauuucuggcccagacaaugaggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauacaagaucuucaaaaugagaaaaggaaaaguagucaaaucagucgaauuggaugcuccuaauuaucauuaugaggagugcuccuguuauccugauacuggcgaaaucacauguguuugcagggauaauuggcauggcucaaauaggccauggauauccuuuaaucaaaauuuggaguaucaaauagguuauauaugcaguggaauuuucggagacaauccacgccccaaugauggaacagguaguuguggcccaauguccccuaacggggcauaugggguaaaaggguuuucauuuaaauacggcaaugguguuuggaucgggagaaccaaaagcacuaacuccaggagcggcuuugaaaugauuugggauccaaauggguggaccgaaacggacaguagcuucucagugaaacaggacauaguagcaauaacugauuggucaggauauagcgggaguuuuguccagcacccagaacugacaggacuagauugcauaagaccauguuucuggguugaguuaaucagagggcggcccaaagagagcacaauuuggacuagugggaguagcauaucuuuuugugguguaaauagugacacugugagcuggucuuggccagacggugcugaguugccauucaccauugacaaguag

SEQ ID NO: 56875 - RNA, 1350 nt, Artificial Sequence
  neuraminidase__InfluenzaA__EPI103069
augaauccaaaucaaaagauaauaaccaucggaucaaucuguaugguaauuggaauaguuagcuuaauguuacaaauugggaacaugaucucaauaugggucagucauucaauucagacagggaaucaacgccaagcugaaccaaucagcaauacuaaauuucuuacugagaaagcuguggcuucaguuacauuagcgggcaauucaucucuuugccccauuagcggaugggcuguauacaguaaggacaacaguauaaggaucgguuccaggggggauguguuuguuauaagagagccguucaucucaugcucccacuuggaauguagaacuuucuuuuugacucagggagccuugcugaaugacaagcacuccaaugggacuaucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaaggaaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggaggaccaaaagcacuaauuccaggagcggcuuugaaaugauuugggauccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccagugggagcagcauaucuuuuugugguguaaauagugacacuguuaguuggucuuggccagacggugcugaguugccauucaccauugacaaguag

SEQ ID NO: 56876 - RNA, 1350 nt, Artificial Sequence; identical to SEQ ID NO: 56852
  neuraminidase__InfluenzaA__EPI227595

SEQ ID NO: 56877 - RNA, 1410 nt, Artificial Sequence
  neuraminidase__InfluenzaA__EPI569385
augaauccaaaucagaaaauaauaacaauuggcucugucucucugaccauugcaacaguauguuuccucaugcagauugccaucuuagcaacgacugugacauugcauuucaagcaaaaugaaugcagcauccccccaaacaaucaaguggugccaugugaaccaaucauaauagaaaagaacauaacagagauaguguauuugaauaacacuaccauagaaaaagaaguuuguccugaaguaccagaauacaggaauuggucgaaaccgcagugucagauuacaggguucgcuccuuucuccaaggacaacucgauucggcuuucugcugguggggacauuuggguaacaagagaaccuuaugugucaugcagucccggcaaauguuaucaguuugcacuugggcaggggaccacgcugaacaacaaacacucaaacgguacaauacaugauaggaucccacaccgaacccuuuuaaugagugaauuggguguuccguuucauuugggaaccaaacaagugugcauagcaugguccagcucaaguugccaugaugggaaagcaugguugcaugucugugucacuggggaugauagaaaugcaacugcuaguuucauuuaugaugggaugcuugcugacaguauugguucauggucucaaaauauccucaggacucaggagucagaauguguuugcaucaauggaacuuguacaguaguaaugacugauggaagugcaucaggaagggccgauacuagaauacuauucauuaaagaagggaaaauuguccauauuagcccauugucaggaagugcucagcauauagaggaauguuccuguuauccccgauauccagauguuagauguguuugcagagauaacuggaagggcucuaauagacccgucauagauauaaauauggcagauuacagcauugauuccaguuauguauguucagggcuuguuggugacacaccuaggaacgaugauagcucuagcagcagcaacugcagggauccuaacaaugagagagggaacccaggggugaaagggugggcauuugacaaugggaaugauguuuggaugggaagaacaaucagcgaagauucgcgcucagguuaugagaccuucagagucaccgaugguuggaccacggccaauucuaaaucacaggucaauagacaaauuauaguugacaauaauaacugguccgguuauucugguauuuucucuguugaaggcaaaagcugcaucaauagguguuuuuauguggaguuaauaagagggaggccacaggagaccagggugugguggacuucgaauaguaucgucguauuuugugguacuucugguacuuauggaacaggcucauggccugauggagcgaauaucaacuucaugccuauauaa

SEQ ID NO: 56878 - RNA, 1380 nt, Artificial Sequence
  neuraminidase__InfluenzaA__EPI736916
augaauccaaaucaaaagauaacaugcauuucagcaacaggaguaacacuaucgguaguaagccugcuaauaggaaucgccaauuugggccuaaacaucggacuacacuacaaagugagugauucaacaacuauaagcauuccaaacaugaaugagaccaacccaacaacaacaaacaucacuaacauuauagugaauaagaacgaagaaagaacauuucucaacuugaccaagccgcuaugugaagucaacucauggcacauucuaucgaaagacaaugcaauaagaauaggugaggaugcucauauacuggucacaagggaaccuuacuuguccugugauccacaaggaugcaggauguuugcucugagucaaggcacaacacucagagggcgacaugcaaauggaaccauacaugauaggagcccauuucgagcucuuauaaguugggaaaugggucaggcacccaguccauauaauacuagggucgaaugcauaggauggucaagcacgucaugccaugauggcauaucaaggaugucaauaugcauaucaggaccaaauaacaaugcaucggcaguggugugguacagggggagaccaguaacagaaaucccaucaugggcagggaacauucuuaggacucaagaaucagaaugugugugccauaaaggaaucugcccaguggucaugacagaugguccagcaaacaacaaggcagcaacuaagauaaucuacuucaaagagggaaagguacagaaaauugaagaacugcaagggaacgcucaacacaucgaagaguguucaugcuacggagcagcagggaugaucaaauguguaugcagagacaauuggaagggggcaaauagaccaauaaucacuauagaucccgaaaugaugacccacacaagcaaauacuuguguucaaaaaucuuaaccgacacaagucguccuaaugaccccaccaaugggaacugcgaugcgccaauaacaggagggagcccagacccagggguaaaaggguuugcauuccuagacggggagaauucauggcuuggaaggacaauuagcaaagacuccagaucaggcuacgaaauguuaaaggucccaaaugcagaaaccgacacucaaucagggccaaccucauaccagcugauugucaacaaccaaaauuggucaggguacucaggggcauucauagacuacugggcaaacaaggaaugcuucaauccuuguuuuuauguggagcuaaucagagggagacccaaagagagugauguacuguggacuuccaauagcaugguagcucucuguggauccagggagcgauugggaucaugguccuggcaugauggugcagaaaucaucuacuuuaaguag

SEQ ID NO: 56879 - RNA, 1380 nt, Artificial Sequence; identical to SEQ ID NO: 56498
  neuraminidase__InfluenzaA__EPI593891

SEQ ID NO: 56880 - RNA, 1380 nt, Artificial Sequence
  neuraminidase__InfluenzaA__EPI691380
augaauccaaaucaaaagauagucugcauuucggucacaggaguaacacuaucaguaguaagccugcuaauaggaaucaccaauuugggccuaaauaucggacuacacuacaaagugagugauucaacaacuauaaacauuccaaacaugaaugagaccaacccaacaacaacaaacaucacuaacauuauaaugaauaagaacgaagaaagaacauuucucaaauugaccaagccgcuaugugaagucaacucauggcacauucuaucgaaagacaaugcaauaagaauaggugaggaugcucauauacuggucacaagggaaccuuaccuguccugugauccacaaggcugcaggauguuugcucugagucagggcacaacacucagagggcaacaugcgaauggaaccauacaugauaggagcccauuucgagcucuuauaaguugggaaaugggucaggcacccaguccauacaauacuagggucgaaugcauaggauggucaagcacgucaugccaugauggcauaucaaggaugucaauaugcauaucaggaccgaauaacaaugcaucggcaguggugugguaccgggggagaccaguaacagaaaucccaucaugggcagggaacauucuuaggacucaagaaucagaaugugugugccauaaaggaaucugcccaguggucaugacagaugguccagcaaacaacaaggcagcaacuaagauaaucuacuucaaagagggaaagauacaaaaaacugaagaacugcaagggaacgcucaacacaucgaagaauguucaugcuacggagcagcagggaugaucaaauguguaugcagagacaauuggaagggggcaaauagaccaauaaucacuauagaucccgaaaugaugacccacacaagcaaauacuuguguucgaaaaucuuaaccgacacaagucguccuaaugaccccaccaaugggaacugugaugcgccaauaacaggagggagcccagacccaggaguaaaaggguuugcauuccuagacggggagaauucauggcuuggacggacaauuagcaaagacuccagaucaggcuacgaaauguuaaaggucccaaaugcagaaaucgacauucaaucagggccaaucucauaccagcugguugucaauaaccaaaauuggucaggguacucaggggcauucauagacuacugggcaaacaaggagugcuucaauccuuguuuuuauguggagcuaaucagggggagacccaaagagagugguguacuguggacuuccaauagcaugguagcucucuguggauccagggagcgauugggaucaugguccuggcaugauggugcagaaaucaucuacuuuaaguag

SEQ ID NO: 56881 - RNA, 1413 nt, Artificial Sequence
  neuraminidase__InfluenzaA__EPI533584
augaauccaaaucaaaagauaacaugcauuucagcaacaggaaugacacuaucgguaguaaguaugcuaauaggaauugccaauuugggcuuaaauaucggacuccacuauaaagugagugauucgacaaauauaaacauuccaaacaugaaugaaaccagcccaacaacaacaauaauaaauaaucacccucagaauaauuucacaaacaucacuaacauuauagugacuaagaacgaggaaggacaucuucucaaccugaccaagccgcuaugugaagucaacucauggcauauucuaucgaaagacaaugcaauaagaauaggugaggaugcucauauaauagucacaagggaaccuuacuuguccugcgauccacagggcuguaggauguuugcucugagccaaggaacaacacucagagggaaacaugcgaauggaaccauacaugacaggagcccguuccgagcucuugugaguugggaaaugggucaggcgcccaguccauacaauacuagggucgagugcauaggauggucaagcacgucgugccacgacggcauaucaaggaugucaauaugcauaucaggaccgaauaacaaugcaucggcaguagugugguauggggggagaccaguaacagagauccccucaugggcagggaacauucuuaggacucaagaaucggagugugugugccauggaggaauaugcccaguggucaugacagaugguccggcaaacaacagggcagaaacuaaaauaaucuauuucaaagaaggaaagauaaagaaaaucgaagaacugaagggggacgcucaacacaucgaagaguguucauguuauggagcaucagagaugaucaaguguauaugcagggacaauuggaaaggggcaaacagaccaguaauaacuauagaucccgagaugaugacccacacaagcaaguacuuguguucaaaaauccuaaccgauacaagccgucccaaugaccccaccaaugggaaaugcgaagcgccaauaacaggagggagcccagacccugggguaaaaggguuugcauuccuagacggugagaacucauggcuuggaaggacuauuagcaaagacuccaggucaggcuaugaaauguuaaaaguuccaaaugcagagaccgacacucaaucgggggcaaucucccaccagauuauugucaacaaccagaauuggucaggguacucuggggcauucauugacuacugggcaaacaaggaaugcuucaauccuuguuucuauguggaacuaaucagagggagacccaaagagaguaguguacuguggacuucaaauagcauuguagcucucuguggauccaaggagcgauugggaucaugguccuggcaugauggugcugaaaucaucuacuuuaaguag

SEQ ID NO: 56882 - RNA, 1380 nt, Artificial Sequence; identical to SEQ ID NO: 56502
  neuraminidase__InfluenzaA__EPI641400

SEQ ID NO: 56883 - RNA, 1380 nt, Artificial Sequence; identical to SEQ ID NO: 56502
  neuraminidase__InfluenzaA__EPI587620

SEQ ID NO: 56884 - RNA, 1410 nt, Artificial Sequence
  neuraminidase__InfluenzaA__EPI569392
augaauccaaaucagaaaauaguaaccauuggcucccuuucguuaggguugguuguauucaauguucuacugcaugccgugagcaucauauuaacaguguuagcccuggggaagagugaaaacaauggaaucugcaauggaacuguagugagggaauacaaugaaacaguuagaauagagaaagugacucaaugguacaauacuagcguagucgaauauguaccgcauuggaaugagggaacuuauauaaauaacaccgaaccaauaugugaugucaagggcuuugcaccuuuuuccaaggacaacgggauaagaguuggcuccaggggacauauuuuugucauaagagagccuuucgucucuuguucaccaguagggugcaggacuuucuuccucacucagggaucucuacucaaugacaaacacucaaauggaacagugaaggauagaagcccauucagaacucucaugagugucgaagugggccaaucacccaauguauaucaagccagguuugaagcuguggcauggucagcaacagccugucaugaugguaagaaguggauggcgauugguguaacagggccagauucuaaagcaguagcaguaguucauuacggaggggugccuacugacguuguuaacuccugggcaggagauauauuaagaacucaggagucaucuuguacuugcauucaagguaauuguuauuggguaaugacugacgguccugccaauagacaggcgcaguauagaauauacaaagcaaaucaaggcaaaauaauuggccgaaaagacguuagcuuuaguggaggacauauugaggaauguucuuguuauccaaaugaugguaaaguggaaugcguguguagagacaacuggacgggaacuaacagaccugugcuaauuauuucgccugaucucucuuacaggguuggguauuuaugugcaggguugcccagugacacuccaagaggggaagauacucaauuugucgguucaugcacuagucccaugggaaaucagggauauggcguaaaaggguucggguuucgacagggaacugauguguggguggggcggacaauuagucgaaccuccagaucaggauuugaaauaauaaggauaaagaaugguuggacgcaaacaagcaaagaacagauuagaagacaggugguuguugauaacucgaauuggucgggauacagugggucuuucacuuuaccaguagaauugucugggagggaauguuugguucccuguuuuugggucgaaaugaucagagguaggccagaagagagaacaaucuggaccucuaguagcuccauuguaauguguggaguugauuaugaaauugccgacuggucauggcacgauggagcuauucuucccuuugacaucgauaaguaa

SEQ ID NO: 56885 - RNA, 1368 nt, Artificial Sequence
  neuraminidase__InfluenzaA__EPI459857
augaauccaaaucagaagauuauaaccauuggaucaauuuguaugguaauaggaacagucagcuuaauuguacaaguuggaaacauaaucuuaauauggguaaaccauucaauccagacaugcauuacuuaugaaaacaacaccuggguaaaucagacauaugucagcaauaccaauuuucuuacugggcaagcuguggcuucaguaacuuuagcaggcaauuccucucuuugccccauuaguggaugggccauauacaguaaggacaaugguauaagaauugguuccaagggggauguauuuguuauaagagaaccauuuaucucguguucucacuuggaaugcaggaccuucuucuuaacccagggagcuuuguugaaugauaagcauucuaauggaaccaucaaagacagaaguccuuacagaaccuugaugaguugccccgugggugaggcuccuuccccauauaacucaagguuugagucuguugcuuggucagcaagugcuugucaugauggcauuaauugguugacaaucggaauuucuggcccagacaaugaggcuguugcuguauugaaauacaaugguguaauaacagacaccaucaagaguuggaggaacaauauacugagaacucaggaaucugaaugugcguguguaaaugguucuugcuuuaccguaaugacagacggaccaaguaaugggcaggcgucauacaagaucuuuaagauagaaaaagggaaaguaguuagaucaguugaauuggaugcaccuaauuaccacuacgaggaaugcuccuguuauccugaugcuggagaaaucaccugugugugcagggauaauuggcauggcucgaaucgaccauggguaucuuucaaucaaaauuuagaguaccaaacaggauacauauguagugggguuuucggagacaguccacgcccuaaugaugggacaggcaguugugguccgguguccucuaacggggcauuuggugugaaaggguuuucauuuaaauacggcaaugguguuuggaucgggagaaccaaaaccacuaauuccagaagcggcuuugaaaugauuugggauccaaauggguggaccgaaacugacaguagcuuuucaaugaagcaagauaucauagcuauaacugauuggucuggauauagugggaguuuuguccaacauccggaacuaacaggauuaaauugcaugagaccguguuucuggguugagcuaaucagaggacagcccagagagaacacaauuuggacuagcggaagcaguauauccuuuugugguguaaauagugaaacuguggguuggucuuggccagacggugcugaguugccauucaccauugacaaguaa

SEQ ID NO: 56886 - RNA, 1416 nt, Artificial Sequence
  neuraminidase__InfluenzaA__EPI242204
augaauccuaaucaaaaacuauuugcauuaucaggaguggcaauagcacuuaguguauugaaccuauugauaggaauuucaaauguuggacugaaugugucucuacacuuaaaaggagagggggucaaacaagagaacaauuugacgugcacaaccauuacccaaaacaacacuacuguaguggaaaacacauacgucaauaacacaacaauaaucaacaaggggacaaauuugaaggcuccaaacuauuugcugcugaauaaaagucuaugcaguguggaaggaugggucgugauagccaaagacaaugcaauaagauucggagaaagugaacaaaucaucguuacuagggagccauaugugucaugcgauccaucaggaugcaagauguaugcccuacaccaaggaacuaccauaaggaacaaacacucaaauggaaccauacaugacagaacgacuuuccguggucucauauccaccccauugggcaccccaccgacagugaguaacagugauuucauauguguuggguggucgaguacaagcugccaugacggaguuggcagaaugacuaucugcauacaggggaacaaugacaaugcuacagcgacgguguauuacaacaggagacuuacuacuacuauuaaaacuugggccaagaauauucugaggacucaggagucagagugcguaugccacaacggcacaugugcaguuguaaugacugaugggcccgccagcagucaagccuauacaaaaauaauguacuuucauaaagggcuaauaauaaaggaagaaccacucaggggaucagccaggcauauugaggaaugcucuuguuauggacacgaucagaaaguaaguuguguaugcagggauaacuggcaaggcgcaaauagacccauuauagagauugauaugagcacacuagagcacacaaguagauacgugugcacuggaguucuaacagauaccaguagaccuggggacaaaccuaauggugauuguuccaauccaauaacuggaaguccuggugcaccgggagugaaaggguucggguucuuaaauggggacaacacauggcuagggaggacuaucagucccagaucuaggaguggguucgagaugcugaaaauacccaaugcagaaaccgacccaaauucuagaauaauagagcggcaggagaucgucgacaacaguaacuggucagguuauucuggaagcuucaucgacuauugggaugaggcuaaugaauguuacaaccccugcuuuuauguagaguuaauuagagggaggccugaggaggcaaaauacgucugguggacgagcaacagucuaauugccuuguguggaagcccagucucaguuggguccgguucuuuccccgauggggcucagauccaauacuuuucguaa

SEQ ID NO: 56887 - RNA, 1416 nt, Artificial Sequence
  neuraminidase__InfluenzaA__EPI408029
augaauccuaaucaaaaacuauuugcauuaucaggaguggcaauagcacuuaguguauugaaccuauugauaggaauuucaaauguuggacugaauaugucucuacacuuaaaaggagagggggucaaacaagagaacaauuugacgugcacaaccauuacccaaaacaacacuacuguaguggaaaacacauacgucaauaacacaacaauaaucaacaaggggacaaaucugaaggcuccaaacuauuugcugcugaauaaaagucuaugcaguguggaaggaugggucgugauagccaaagacaaugcaauaagauucggagaaagugaacaaaucaucguuacuagggagccauaugugucaugcgauccaucaggaugcaagauguaugcccuacaccaaggaacuaccauaaggaacaaacacucaaauggaaccauacaugacagaacgacuuuccguggucucuuauccaccccauugggcaccccaccgacagugaguaacagugauuucauauguguuggguggucgaguacaagcugccaugacggaguugguagaaugacuaucugcauacaggggaauaaugacaaugcuacagcgacgguguauuacaacaggagacuuacuacuacuauuaaaacuugggccaagaauauucugaggacucaggagucagagugcguaugccacaacggcacaugugcaguuguaaugacugaugggcccgccagcagucaagccuauacaaaaauaauguacuuucauaaagggcuaauaauaaaggaagaaccacucaggggaucagccaggcauauugaggaaugcucuuguuauggacacgaucagaaaguaaguuguguaugcagggauaacuggcaaggcgcaaauagacccauuauagagauugauaugagcacacuagagcacacaaguagauacgugugcacuggaguucuaacagauaccaguagaccuggggacaaaccuaauggugauuguuccaauccaauaacuggaaguccuggugcaccgggagugaaaggguucggguucuuaaauggggacaacacauggcuagggaggacuaucagucccagaucuaggaguggguucgagaugcugaaaauacccaaugcagaaaccgacccaaauucuagaauaauagagcggcaggagaucgucgacaacaguaaccggucagguuauucuggaagcuucaucgacuauugggaugaggcuaaugaauguuacaaccccugcuuuuauguagaguuaauuagagggaggccugaggaggcaaaauacgucugguggacgagcaacagucuaauugccuuguguggaagcccagucucaguuggguccgguucuuuccccgauggggcucagauccaauacuuuucguaa

SEQ ID NO: 56888 - RNA, 1398 nt, Artificial Sequence; identical to SEQ ID NO: 55809
  neuraminidase__InfluenzaA__EPI439509

SEQ ID NO: 56889 - RNA, 1350 nt, Artificial Sequence
  neuraminidase__InfluenzaA__EPI164223
augaauccaaaucagaagauaauaaccauugggucaaucuguaugguaauuggaauaguuagcuuaauguuacaaauugggaacaugaucucaauaugggucagucauucaauucaaacagggaaucaacaccaagcugaaccaaucagaaaugcuaauuuucuuacugagaacgcuguggcuucaguaacauuagcgggcaauucaucucuuugccccguuagaggaugggcuguacacaguaaagacaacaguauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauugaaugcuccuaauuaucacuaugaggaaugcuccuguuauccugaugcuggcgaaaucacaugugugugcagggauaauuggcauggcucgaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucggaagaaccaaaagcacuaauuccaggagcggcuuugaaaugauuugggauccaaauggguggacugaaacggacaguaacuuuucggugaaacaagauauaguagcaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 56890 - RNA, 1398 nt, Artificial Sequence; identical to SEQ ID NO: 55809
  neuraminidase__InfluenzaA__EPI486493

SEQ ID NO: 56891 - RNA, 1398 nt, Artificial Sequence
  neuraminidase__InfluenzaA__EPI740737
augaauccaaaucagaagauucuaugcacuucagccacugcuaucacaauaagcgcaaucgcaguacucauuggaauagcaaaccuaggauugaacauaggacugcauuuaaaaccgggcugcaauugcucacacucacaaccugaaacaaccaacacaagccaaacaauaauaaacaacuauuauaaugaaacaaacaucaccaacauccaaauagaagaaagaacaagcaggaauuucaauaacuuaacuaaagggcucuguacuauaaauucauggcacauauaugggaaagacaaugcaguaagaauuggagaaagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacagugcacaacagcaggguggaaugcauuggguggucaaguacuaguugccaugaugguaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggccugccacuggaccugcagacacaagaauauacuauuuuaaagaggggaaaauauugaaaugggagucucugacuggaacugcuaagcauauugaagaaugcucauguuacggggaacgaacagggauuaccugcacaugcagggacaauuggcagggcucaaauagaccagugguucagauagacccaguagcaaugacacacacuagucaauauauaugcaguccuguucuuacagacaguccccgaccgaaugacccaaauauaggcaaguguaaugacccuuauccagguaacaauaacaauggagucaagggauucucauaccuggauggggcuaacacuuggcuagggaggacaauaaguacagccucgaggucuggauacgagauguuaaaagugccaaaugcauugacagaugauagaucaaagcccauucaaggucagacaauuguauuaaacgcugacuggagugguuacaguggguccuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 56892 - RNA, 1398 nt, Artificial Sequence
  neuraminidase__InfluenzaA__EPI730494
augaauccaaaccagaagauucuaugcacuucagccacugccaucacaauaggcgcaaucgcaguacucauuggaauagcaaaccuaggauugaacauaggacugcaucuaaaaccgggcugcaauugcucacacucacaaccugaaauaaccaacacaagccaaacaauaauaaacaacuauuauagugaaacaaacaucaccaacauccaaauggaagagagaacaagcaagaauuucaauaacuuaacuaaagggcucuguacuauaaauucauggcacauauaugggaaagacaaugcaguaagaauuggagagagcucggauguuuuagucacaagagaacccuaugugucaugcgacccagaugaaugcagguucuaugcucucagccaaggaacaacaaucagagggaaacacucaaacggaacaauacacgauaggucccaguaucgugcccugauaagcuggccacuaucaucaccgcccacaguguacaacagcaggguggaaugcauuggguggucaagcacuaguugccaugauggcaaauccaggaugucaauauguauaucaggaccaaacaacaaugcaucugcuguaguaugguacaacagaaggccuguugcagaaauuaacacaugggcccgaaacauacuaagaacacaggagucugaauguguaugccacaacggcguaugcccaguaguguucacugauggaucugccacuggaccugcagacacaagaauauacuauuuuaaagaggggaaaauauugaagugggagucucugacuggaacugcuaagcauauugaagaaugcucauguuacggggaacgaacaggaauuaccugcacaugcagggacaauuggcagggcucaaauaggccagugauucagauagacccaguagcaaugacacacacuagucaauauauaugcaguccuguucuuacagacaauccccgaccaaaugacccaaauauagguaaguguaaugacccuuauccagguaauaauaacaauggaaucaagggauucucauaccuggauggggcuaacacuuggcuagggaggacaauaagcacagccucgaggucuggauacgagauguuaaaagugccaaaugcauugacagaugauagaucaaagccuauucaaggucagacaauuguguuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 56893 - RNA, 1398 nt, Artificial Sequence
  neuraminidase__InfluenzaA__EPI712925
augaauccaaaucagaagauucuaugcacuucagccacugcuaucacaauaggcgcaaucgcaguacucauuggaauagcaaaccuaggauugaacauaggacugcauuuaaaaccgggcugcaauugcucacacucacaaccugaaacaaccaacacaagccaaacaauaauaaacaacuauuauaaugaaacaaacaucaccaacauccaaauagaagaaagaacaagcaggaauuucaauaacuuaacuaaagggcucuguacuauaaauucauggcacauauaugggaaagacaaugcaguaagaauuggagaaagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacagugcacaacagcaggguggaaugcauuggguggucaaguacuaguugccaugaugguaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggccugccacuggaccugcagacacaagaauauacuauuuuaaagaggggaaaauauugaaaugggagucucugacuggaacugcuaagcauauugaagaaugcucauguuacggggaacgaacagggauuaccugcacaugcagggacaauuggcagggcucaaauagaccagugguucagauagacccaguagcaaugacacacacuagucaauauauaugcaguccuguucuuacagacaguccccgaccgaaugacccaaauauagguaaguguaaugacccuuauccagguaacaauaacaauggagucaagggauucucauaccuggauggggcuaacacuuggcuagggaggacaauaaguacagccucgaggucuggauacgagauguuaaaagugccaaaugcauugacagaugauagaucaaagcccauucaaggucagacaauuguauuaaacgcugacuggagugguuacaguggguccuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 56894 - RNA, 1398 nt, Artificial Sequence
  neuraminidase__InfluenzaA__EPI448938
augaauccaaaucagaagauucuaugcacuucagccacugcuaucauaauaggcgcaaucgcaguacucauuggaauggcaaaccuaggauugaacauaggacugcaucuaaaaccgggcugcaauugcucacacucacaaccugaaacaaccaacacaagccaaacaauaauaaacaacuauuauaaugaaacaaacaucaccaacauccaaauggaagagagaacaagcaggaauuucaauaacuuaacuaaagggcucuguacuauaaauucauggcacauauaugggaaagacaaugcaguaagaauuggagagagcucggauguuuuagucacaagagaacccuauguuucaugcgacccagaugaaugcagguucuaugcucucagccaaggaacaacaaucagagggaaacacucaaacggaacaauacacgauaggucccaguaucgcgcccugauaagcuggccacuaucaucaccgcccacaguguacaacagcaggguggaaugcauuggguggucaaguacuaguugccaugauggcaaauccaggaugucaauauguauaucaggaccaaacaacaaugcaucugcaguaguaugguacaacagaaggccuguugcagaaauuaacacaugggcccgaaacauacuaagaacacaggaaucugaauguguaugccacaacggcguaugcccaguaguguucaccgaugggucugccacuggaccugcagacacaagaauauacuauuuuaaagaggggaaaauauugaaaugggagucucugacuggaacugcuaagcauauugaagaaugcucauguuacggggaacgaacaggaauuaccugcacaugcagggacaauuggcagggcucaaauagaccagugauucagauagacccaguagcaaugacacacacuagucaauauauaugcaguccuguucuuacagacaauccccgaccgaaugacccaaauauagguaaguguaaugacccuuauccagguaauaauaacaauggagucaagggauucucauaccuggauggggcuaacacuuggcuagggaggacaauaagcacagccucgaggucuggauacgagauguuaaaagugccaaaugcauugacagaugauagaucaaagcccauucaaggucagacaauuguauuaaacgcugacuggagugguuacaguggaucuuucauggacuauugggcugaaggggacugcuaucgagcguguuuuuauguggaguugauacguggaagacccaaggaggauaaagugugguggaccagcaauaguauaguaucgauguguuccaguacagaauuccugggacaauggaacuggccugauggggcuaaaauagaguacuuccucuaa

SEQ ID NO: 56895 - RNA, 1410 nt, Artificial Sequence
  neuraminidase__InfluenzaA__EPI445995
augaauccaaaucaaaagauaauagcacuuggcuccgcuucucuaacuauugcgauaauaugucuacucauucagauugccaucuuagcaacgacuaugacacuacauuucaugcagaaugaacacacuaacuccacgagaaauaaaguaguaccaugugagucaaucauaauagaaaggaacauaacagagauaguacauuugaaugguacuaucauagagaaggagaguugucccaaagcaguagaauacaagaauuggucaaaaccucaaugucaaauuacaggguuugccccuuucuccaaggacaacucaauuaggcuuucugcugguggggauauuugggugacaagagaaccuuaugugucgugcagucucaguaaauguuaucaauuugcacuugggcagggaaccacuuugaacaacagacacucaaauggcacaacacaugauagaaguccauauagaacccuucuaaugagugaauugggugucccauuucauuugggaaccaaacaagugugcauagcaugguccagcucaagcugccaugaugguagggcauggcuacauguuugugucacuggagaugauaagaaugcgacugcuaguguuauuuauggcgggaugcuuacugacaguauugguucauggucuaaaaacauccucagaacucaggagucagaaugcguuugcaucaauggaacuuguacaguaguaaugacugauggaagugcaucaggaagggcugauaccagaauacuauucauuagagaagggaagauuguccacauuagcccacugucaggaagugcucagcauguggaggaaugcucuuguuauccucgauacccagaaguuagauguguuugcagagacaauuggaaaggcuccaauagaccuguauuauacauaaauguggcagauuauaguauugauuccaguuaugugugcucaggacuuguuggcgacacaccaagaaaugaagacaguuccagcagcaguaacugcagggauccuaauaaugagagaggaggcccaggagugaaagggugggcguuugacaauggagaugauguuuggaugggaagaacaaucaaaaaggacucgcgcgcagguuaugaaacuuucagggucguugacgguuggaccuuggcuaauuccaagucacagacaaauaggcaagucauaguugacagugauaacuggucuggguauucuggaauguucucuguugaaggcaagaccugcaucaacagguguuuuuauguggaauugauaagagggagaccacaggagaccagagugugguggacuucaaauagcaucauuguauucuguggaacuucagguaccuauggaacaggcucauggccugauggagcggauaucaauuucaugucuauauaa

SEQ ID NO: 56896 - RNA, 1410 nt, Artificial Sequence
  neuraminidase__InfluenzaA__EPI470861
augaauccaaaucagaagauaauagcaauuggcucuguuucucuaacuauugcgacaauaugccuccucaugcagauugcuaucuuagcaacgacuaugacacuacauuucaagcagaaugaaugcaucaacuccucgaauaaucaaguagugccaugugaaccaaucauaauagaaaggaacauaacagagauagugcauuugaauaguacuaccuuagagaaggaaauuuguccuaaaguagcagacuacaggaauuggucaaaaccacaaugucaaaucacaggguucgcuccuuucuccaaggacaauucaauuaggcucuccgcagguggagauauuugggugacaagagaaccuuauguaucgugcggucuugguaaauguuaucaauuugcacuugggcagggaaccacuuuggagaacaaacacucaaacggcacagcacaugauagaacuccucauagaacccuuuuaaugaaugaguuggguguuccguuucauuuggcaaccaaacaagugugcauagcaugguccagcucaagcugccaugaugggaaagcaugguuacauguuugugucacuggggaugauagaaaugcaacggcuagcaucauuuaugaugggauacuuguugacaguauugguucauggucuaaaaacauccucagaacucaggagucagaaugcguuugcaucaauggaaccugugcaguaguaaugacugauggaagugcaucaggaagggcugacacuagaauacuauuuauuagagaggggaaaauugcacacauuagcccauugucaggaagugcucagcauguggaggaaugcuccuguuacccccgauauccagaaguuagauguguuugcagagacaauuggaagggauccaauaggcccguucuauauauaaauauggcaaauuauaguauugauuccaguuaugugugcucaggacuuguuggcgacacaccaagaaaugaugauaggucuagcagcagcaacugcagagauccuaauaacgagagaggggccccaggaguaaaagggugggccuuugacaauggaaaugacauuuggaugggaagaacaaucaaaaaggauucgcgcucagguuaugagacuuucagggucauuggugguuggaccacugcuaauuccaagucacagauaaauagacaagucauaguugacagugauaacucgucuggguauucugguaucuucucuguugaaggcaaaagcugcaucaacagguguuuuuacguggaguugauaagaggaagaccaaaggagacuagggugugguggacuucaaauagcaucauuguauuuuguggaacuucagguaccuauggaacaggcucauggccugauggggcgaauaucaauuucaugccuauauaa

SEQ ID NO: 56897 - RNA, 1401 nt, Artificial Sequence
  neuraminidase__InfluenzaA__EPI498036
augaauccaaaccagaagauaauagcaauuggcucuguuucucugaucauugcgauaauaugucuccucaugcagauugccaucuuaacaacgacuaugacacugcauuucaggcagaaugaaugcaguaacccaucgaauaaucaagugaugccaugugaaccaaucauauuagagaggaacacagugcacuugaauagcacuaucauagagagggaaauuugucccaaaguagcagacuacaagaauuggucaaaaccacaaugucaaauuacaggguucgcuccuuucucaaaggacaacucaauuaggcuuucugcagguggggauaucugggugacaagagaaccuuaugucucaugcagucucgacaaauguuaucaauuugcacuugggcagggaaccacccugaaaaacaagcacucaaauggcacuacucaugauagaaccccucacagaacucuuuuaaugaaugaguuaggugucccauuucauuugggaaccaaacaagugugcauagcauggucuaguucaagcugcuaugauggaaaagcaugguuacauauuuguguuacuggggaugacaaaaaugcuacugcuaguaucaucuaugaugggaugcuuguugacaguauugguucaugguccaaaaacauccucagaacucaggagucagaaugcguuuguaucaauggaacuugugcagugguaaugacugauggaagugcaucaggaaaggcagacacuaggguauuauucauaagagaagggaaaauuauaaauauuagcccauugucaggaagugcucagcacguugaggaaugcucuuguuauccucgguauccugaaguuagaugugucugcagagacaauuggaagggcuccaauaggcccauucuauauauaaauauggcugauuauagcauugaguccaguuaugugugcucaggacuuguuggcgacacaccaagaaaugaugauagcuccagcaguagcaacugcagagauccuaauaacgaaagaggggccccaggagugaaagggugggccuuugaugaugggaaugauguuuggaugggacggacaaucaaaaaugguucacgcucagguuaugagacuuuuagggucgucaaugguuggaccauggcuaauucaaagucacagauaaauaggcaagucauaguugacagugacgacuggucuggauauucuggcaucuucucuguugaaggcaaaaaaugcaucaacagguguuuuuauguggaguugauaagagggagaccacaggaacccagagugugguggaccucaaauagcaucauuguauucuguggaaccucagguacauauggaacaggcucauggccugauggagcgaauaucaacuucaugccaguauaa

SEQ ID NO: 56898 - RNA, 1410 nt, Artificial Sequence
  neuraminidase__InfluenzaA__EPI470902
augaauccaaaucagaagauaguagcaauugguuccgccucccuaacuauugcgacaaugugccuccucaugcagauugcccucuuugcuacaacuaugacacuacauuucaagcagacgggaugcacaaacuccucugacaaucaagcagugccauguggaccaaucauaauagaaaggaacauaacagaaauagugcauuugaauagcaccacuuuagaaaaggaaacuuguccuaaaucagcaggguacaggaauuggucuaaaccacaaugucaaaucacaggauucgcuccuuucuccaaggacaauucaauuaggcucgccgcagcuggagauauuugggugacaagagaaccuuaugugucaugcggucuugguaaauguuaucaauuugcacuugggcaggggaccaccuuggacaacaaacacucaaacggcacaacacaugauagaacuccucauagaacccuuuuaaugaaugaguuggguguuccguuucauuuggcaaccaaacaaguguguauagcaugguccagcucaagcugccaugauggaaaagcaugguuacauguuugugucacuggggaugauaagaaugcaaccgcuaguaucauuuaugaugggauacuuguugacagcauugcuucauggucuaaaaacauccucagaacucaggagucagaaugcguuuguauuaauggaaccuguacgguaguaaugacagauggaagugcaucaggaagggcugacaccagaauacuauuuauuagagaggggaaaaucguacacauuagcccauugucaggaagugcucagcauguugaggaaugcuccuguuacccccgauauccagaaguuagauguguuugcagagacaauuggaagggauccaauagacccguucuauuuauaaauauggcagauuauaguauugauuccaguuauguguguucagggcuuguuggcgacacaccaagaaaugaugauagaucuagcagcagcaacugcagagauccuaauaacgaaagaggagccccaggagugaaagggugggccuucgacaguggaaaugauauuuggaugggaagaacgaucgaaaaggauucgcgcucagguuaugagacuuucagggucauuggugguuggagcacagcuaauuccaagucacagauaaauagacaagucauaguugaucgugauaacucgucuggguauucugguauuuucucuguugaaggcaaaaguugcaucaacagguguuuuuauguagaguugauaagaggaagaccaaaagagaauagagugugguggacuucaaacagcaucauuguauuuuguggaacuucagguacuuauggaacaggcucauggccugauggggcgaauaucaaucucaugccgauauaa

SEQ ID NO: 56899 - RNA, 1401 nt, Artificial Sequence
  neuraminidase__InfluenzaA__EPI838241
augaauccaaaccagaagauaacagcaauuggcucugucucucuaaucauugcgauaauaugucuccucaugcagauugccaucuuaacaacgacuaugacacuacauuucaggcagaaugaaugcagcaacucaucgaauaaucaggugaugccaugugaaccaaucauaauagagaggaacacagugcauuuaaauagcacuaccauagagagggaaauuuguccuaaaguagcagaauacaagaauuggucaaaaccacaaugucaaauuacaggguucgccccuuuuucaaaagacaacucaauuaggcucucugcaaguggggauaucugggugacaagagaacccuaugucucaugcagucucgacaaauguuaucaauuugcacuugggcagggaaccacccugaaaaacaagcacucaaauggcacugcacaugauagaaccccucacagaacucuuuuaaugaaugaguuaggugucccauuucauuugggaaccaaacaagugugcauagcauggucuaguucaagcugcuaugauggaaaagcaugguugcauguuuguguuacuggggaugauaaaaaugcuacugcuaguaucaucuaugaugggaugcuugucgacaguauugguucaugguccaaaaacauccucagaacucaggagucagaaugcguuugcaucaauggaacuugugcagugguaaugacugauggaagugcaucaggaaaggccgacacuagaguauuauuuauaagagaagggaaaauuauaaauauuagcccauugucaggaagugcucagcacguugaggaaugcucuuguuacccucgguauccugaaguuaggugugucugcagagacaauuggaagggcuccaauaggcccauucuauauauaaauauggcugauuauagcauugaguccaguuaugugugcucuggacuuguuggcgacacaccaagaaaugaugauagcuccagcagcagcaacugcagagacccuaauaacgaaagaggggccccaggagugaaagggugggccuuugacgacgggaaugauguuuggaugggacgaacaaucaaaaaugguucacgcucagguuaugagaccuuuagggucgucaaugguuggaccauggcuaauucaaagucacagauaaauaggcaagucauaguugagagugaugacuggucuggguauucuggcaucuucucuguugaaggcaaaaaaugcaucaacagguguuuuuauguggaguugauaagagggagaccacaggaacccagagugugguggaccucaaauagcaucauuguguucuguggaaccucugguacauauggaacaggcucauggccugauggagcgaauaucaacuucaugccuauauaa

SEQ ID NO: 56900 - RNA, 1401 nt, Artificial Sequence; identical to SEQ ID NO: 56899
  neuraminidase__InfluenzaA__EPI680525

SEQ ID NO: 56901 - RNA, 1401 nt, Artificial Sequence; identical to SEQ ID NO: 56507
  neuraminidase__InfluenzaA__EPI690481

SEQ ID NO: 56902 - RNA, 1755 nt, Artificial Sequence
  hemagglutinin__InfluenzaB__ABL76276
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56903 - RNA, 1755 nt, Artificial Sequence
  hemagglutinin__InfluenzaB__ABL76287
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaaugugugugggggucacaccuucagcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcuguuccaagggacaacaacaaaacagcaacgaauccacuaacaauagaaguaccacacaucuguacaaaagaagaagaccaaauuacuguuuggggguuccauucugauaacaaaauccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauaugguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaagggggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56904 - RNA, 1755 nt, Artificial Sequence
  hemagglutinin__InfluenzaB__ABL76298
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaaugugugugggggucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaauucaccucaucugcuaauggaguaaccacacauuauguuucucagauuggcggcuucccggaccaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuuaagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuggacaggauagcugcuggcaccuuuaaugcaggagaauuuucucuucccacuuuugauucacugaauauuacugcugcaucuuuaaaugaugauggguuggauaaucauacuauacugcucuacuacucaacugcugcuucuaguuuggcuguaacauugaugauagcuauuuuuauuguuuauauggucuccagagacaauguuucuugcuccaucugucuauaa

SEQ ID NO: 56905 - RNA, 1755 nt, Artificial Sequence
  hemagglutinin__InfluenzaB__ABL76309
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaaugugugugggggucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaaguggauuuuucgcaacaauggcuugggcuguuccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaagaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaagggggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcagaagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56906 - RNA, 1755 nt, Artificial Sequence
  hemagglutinin__InfluenzaB__ABL76331
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcgaaucucaaaggaacaaagaccagagggaaacuaugcccaaccugucucaacugcacagaucuggauguggccuuaggcagaccaauguguguggggaucacaccuucagcaaaagcuucaauacuccacgaagucagaccuguuacauccggaugcuuuccuauaaugcacgacagaacaaaaaucagacagcuacccaaucuucucagaggguaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcuguuccaagggacaacaacaaaacagcaacgaauccacuaacaauagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaaguggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauaugguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaagggggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcucuaucugucuauaa

SEQ ID NO: 56907 - RNA, 1755 nt, Artificial Sequence
  hemagglutinin__InfluenzaB__ABL76342
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaaugugugugggggucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcuguuccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcgacuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaagaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaagggggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcacuuuuaaugcaggagauuuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56908 - RNA, 1755 nt, Artificial Sequence
  hemagglutinin__InfluenzaB__ABL76353
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaaugugugugggggucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcuguuccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaagaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaagggggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcacuuuuaaugcaggagauuuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56909 - RNA, 1755 nt, Artificial Sequence
  hemagglutinin__InfluenzaB__ABL76375
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56910 - RNA, 1755 nt, Artificial Sequence
  hemagglutinin__InfluenzaB__ABL76386
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56911 - RNA, 1755 nt, Artificial Sequence
  hemagglutinin__InfluenzaB__ABL76408
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccaaggggcaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacugaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56912 - RNA, 1755 nt, Artificial Sequence
  hemagglutinin__InfluenzaB__ABL76419
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaaaucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccaaggggcaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauaugguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56913 - RNA, 1758 nt, Artificial Sequence
  hemagglutinin__InfluenzaB__ABL76441
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuauguuucacagauugguggcuucccaaaucaaacagaagacggaggacuaccacaaagugguagaauuguuguugauuacauggugcaaaaaucugggaaaccaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaccucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgaugaauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56914 - RNA, 1758 nt, Artificial Sequence
  hemagglutinin__InfluenzaB__ABL76463
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccucaagaguacucaagaagccauaaacaagauaacaaaaaaucucaacucuuugagugagcuggaaguaaagaaucuucaaagacuaagcggugccauggaugaacuccacaacgaaauacuagaacuagacgagaaagugaaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagacuugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56915 - RNA, 1758 nt, Artificial Sequence
  hemagglutinin__InfluenzaB__ABL76474
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuauguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaccucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgaugaauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56916 - RNA, 1758 nt, Artificial Sequence
  hemagglutinin__InfluenzaB__ABL76485
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucguaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaaaaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56917 - RNA, 1758 nt, Artificial Sequence
  hemagglutinin__InfluenzaB__ABL76507
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56918 - RNA, 1758 nt, Artificial Sequence
  hemagglutinin__InfluenzaB__ABL76518
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaaaccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56919 - RNA, 1758 nt, Artificial Sequence
  hemagglutinin__InfluenzaB__ABL76529
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucguaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56920 - RNA, 1758 nt, Artificial Sequence
  hemagglutinin__InfluenzaB__ABL76540
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucaaaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56921 - RNA, 1758 nt, Artificial Sequence
  hemagglutinin__InfluenzaB__ABL76551
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuuccuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauggcuaucuuuguuguuuauauggucuccagagacaauguuucuugcuccaucugucuauaa

SEQ ID NO: 56922 - RNA, 1758 nt, Artificial Sequence
  hemagglutinin__InfluenzaB__ABL76562
augaaggcaauaauuguacuacucaugguaguaacauccaaugcagaucgaaucugcacuaggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugauguaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauag

SEQ ID NO: 56923 - RNA, 1758 nt, Artificial Sequence
  hemagglutinin__InfluenzaB__ABL76573
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56924 - RNA, 1758 nt, Artificial Sequence
  hemagglutinin__InfluenzaB__ABL76584
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 56925 - RNA, 1758 nt, Artificial Sequence; identical to SEQ ID NO: 56923
  hemagglutinin__InfluenzaB__ABL76595

SEQ ID NO: 56926 - RNA, 1758 nt, Artificial Sequence
  hemagglutinin__InfluenzaB__ABL76606
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaccaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56927 - RNA, 1758 nt, Artificial Sequence
  hemagglutinin__InfluenzaB__ABL76617
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaaaaguuucaauacuccaugaagucagaccuguuacaucggggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacgauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56928 - RNA, 1755 nt, Artificial Sequence
  hemagglutinin__InfluenzaB__ABL76628
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccacacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 56929 - RNA, 1755 nt, Artificial Sequence
  hemagglutinin__InfluenzaB__ABL76639
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccaugaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaagcaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugaucgcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 56930 - RNA, 1755 nt, Artificial Sequence
  hemagglutinin__InfluenzaB__ABL76683
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucguauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 56931 - RNA, 1752 nt, Artificial Sequence
  hemagglutinin__InfluenzaB__ABL76694
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucuaaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaacgcagaaagagcaccaggaggacccuacagacuuggaaccucaggaucuugcccuaacguuaccaguagagacggauucuucgcaacaauggcuugggcugucccaagggacaacaaaacagcaacgaauccacuaacaguagaaguaccauacauuuguacaaaaggagaagaccaaauuacuguuuggggguuccauucugauaacaaaacccaaaugaaaaaccucuauggagacucaaauccucaaaaguucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugcgcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauaa

SEQ ID NO: 56932 - RNA, 1758 nt, Artificial Sequence
  hemagglutinin__InfluenzaB__ABL76716
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggucaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56933 - RNA, 1755 nt, Artificial Sequence
  hemagglutinin__InfluenzaB__ABL76760
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaaugugugugggggucacaccuucagcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacgauggcuugggcuguuccaagggacaacaacaaaacagcaacgaauccacuaacaauagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauaugguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaagggggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuugaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56934 - RNA, 1755 nt, Artificial Sequence
  hemagglutinin__InfluenzaB__ABL76771
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaaugugugugggggucacaccuucagcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcuguuccaagggacaacaacaaaacagcaacgaauccacuaacaauagaaguaccacacaucuguacaaaagaagaagaccaaauuacuguuuggggguuccauucugaugacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauaugguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaagggggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaauacugggucccucugcuguagacauagggaauggaugcuucgaaaccaaacacaagugcaaccagaccugcuuagacaggauagcugcuggcaccuuugaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56935 - RNA, 1755 nt, Artificial Sequence
  hemagglutinin__InfluenzaB__ABL76782
augaaggcaauaauuguacuacucaugguaguaacauccaaugcagaucgaaucugcacugggauaacaucgucaaacucaccucauguggucaaaacagccacucaaggggaggucaaugugacuggugugauaccacugacaacaacaccaacaaaaucccauuuugcaaaucucaaaggaacaaagaccagagggaaacuaugcccaaccugucucaacugcacagaucuggauguggccuuaggcaguccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacucaaaacguuaucaacauagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaagcccaaaugaaaaaccucuauggagacucaaauccucaaaaguucacaucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggggcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauucucgagcuggaugagaaaguggaugaucucagagcugacacaauaagcucacaaauagaacuugcggucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56936 - RNA, 1755 nt, Artificial Sequence
  hemagglutinin__InfluenzaB__ABL76793
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaaugggauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56937 - RNA, 1755 nt, Artificial Sequence
  hemagglutinin__InfluenzaB__ABL76815
augaaggcaauaauuguacuacucaugguaguaacauccaaugcagaucgaaucugcacugggauaacaucaucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagauuuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacacaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccccaaaaguucaccucaucugcuaauggaauaaccacacauuauguuucucagaucggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56938 - RNA, 1758 nt, Artificial Sequence
  hemagglutinin__InfluenzaB__ABL76826
augaaggcaauaauuguacuacucaugguaguaacauccaaugcagaccgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccagaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacuugcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56939 - RNA, 1758 nt, Artificial Sequence
  hemagglutinin__InfluenzaB__ABL76837
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaguuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaguagaaguaccauacauuuguacagaaggagaagaccaaauuaccguuuggggguuccacucugauagcgaaacccaaauggcaaaacucuauggggacucaaagccccagaaguucaccucaucuuccaacggagugaccacacauuacguuucacagauugguggcuucccaaaucaaacggaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaagauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagguaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56940 - RNA, 1755 nt, Artificial Sequence
  hemagglutinin__InfluenzaB__ABL76848
augaaggcaauaauuguacuacucaugguaguaacauccaaugcagaucgaaucugcacugggauaacaucgucaaacucaucucauguggucaaaacagcuacucaaggggaggucaaugugacuggugcgauaccacugacaacaacaccaacaaaaucucauuuugcaaaucucaaaggaacaaagaccagagggaaacuaugcccgaccugucucaacugcacagauuuggauguggccuugggcagaccaauguguguggggaucacaccuccggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaagagcggauuuuucgcaacaauggcuugggcugucccaagggacaacaacaaaacagcaacaaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauuggcggcuucccggaccaaacagaagacggagggcuaccacaaagcggcagaauuguuguugauuacauggugcaaaaaccugggaaaacagggacaauugucuaucaaagagggauuuuguugccucaaaaaguguggugcgcgaguggcaggaguaaaguaauaaaaggguccuugccuuuaauuggugaagcagauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56941 - RNA, 1755 nt, Artificial Sequence
  hemagglutinin__InfluenzaB__ABL76859
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagauuuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacacaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccccaaaaguucaccucaucugcuaauggaauaaccacacauuauguuucucagaucggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56942 - RNA, 1755 nt, Artificial Sequence
  hemagglutinin__InfluenzaB__ABL76881
augaaggcaauaauuguacuacuaaugguaguaacauccaaugcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaggaccagagggaaacuaugcccagacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcaucaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacgaaacccaaaugaaaaaccucuauggagacucaaauccucaaaaguucaccucaucugcuaauggaguaaccacacauuauguuucucagauuggcggcuucccagaucaaaaagaagacggaggacuaccacaaagcggcagaauuguuguugauuacauggugcaaaaaccugggaaaacaggaacaauugucuaucaaagagguguuuuguugccucaaaagguguggugcgcgaguggcagaagcaaaguaauaaaaggguccuugccuuuaauuggugaagcagauugccuucaugaaaaauacgguggguuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 56943 - RNA, 1755 nt, Artificial Sequence
  hemagglutinin__InfluenzaB__ABL76892
augaaggcaauaauuguacuacucaugguaguaacauccaacgcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaggaccagagggaaacuaugcccagacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaacccaaaugaaaaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggguuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcagauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcgggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 56944 - RNA, 1755 nt, Artificial Sequence
  hemagglutinin__InfluenzaB__ABL76903
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucuuaacuguacagaucuggauguggccuugggcagaccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaagcguuaucgaugcagaaaaggcaccaggagggcccuacagacuuggaaccucaggaucuugcccuaaugcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagaugacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugauucaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaccucagagcugacacuauaagcgcacaaauagaacuugcagucuugcuuuccaacgaaggaauaauaaacagugaagacgagcauuuauuggcacuugagagaaaacuaaagaaaaugcugggucccucugcuguagacauaggaaauggaugcuucgaaaccaaacacaagugcaaccagaccugcuuggacaggauagcugcuggcaccuuuaaugcaggagaauuuucucuccccacuuuugacucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 56945 - RNA, 1758 nt, Artificial Sequence
  hemagglutinin__InfluenzaB__ABL76914
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaagcccaaauggcaaaacucuauggggacucaaagccccagaaguucaccucaucuuccaacggagugaccacacauuacguuucacagauugguggcuucccaaaucaaacggaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaagauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56946 - RNA, 1755 nt, Artificial Sequence
  hemagglutinin__InfluenzaB__ABL76936
augaaggcaauaauuguacuacucaugguaguaacauccaaugcagaucgaaucugcacugggauaacaucgucaaacucaccucauguagucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuugggcagaccaauguguguggggaccacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccauacauuuguacaaaagaagaagaccaaauuacuguuuggggguuccauucugaugacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaaacuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauauggucuccagagacaauguuucuugcuccaucugucuauaa

SEQ ID NO: 56947 - RNA, 1755 nt, Artificial Sequence
  hemagglutinin__InfluenzaB__ABL76947
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugaugacaaaacccaaaugaaaaaccucuauggagacucaaauccucaaaaguucaccucaucuacuaauggaauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcaguuuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56948 - RNA, 1758 nt, Artificial Sequence
  hemagglutinin__InfluenzaB__ABL76958
augaaggcaauaauuguacuacucaugguaguaacauccaaugcagaucgaaucugcacugggauaacaucgucaaacucgccccauguggucaaaacugcuacucaaggggaagucaaugugacuggugugauaccacugacaacaacacccaccaaaucucauuuugcaaaucucaaaggaacaaaaaccagagggaaacuaugcccaaaaugucucaacugcacagaucuggacguggccuugggcagaccaaaaugcacggggaacauaccuucggcaaaaguuucaauacuccaugaagucagaccuguuacaucugggugcuuuccuauaaugcacgacagaacaaaaauuagacagcugcccaaucuucucagaggauacgaacauaucagguuaucaacccauaacguuaucaaugcagaaaaggcaccaggaggacccuacaaaauuggaaccucagggucuugcccuaacguuaccaauggaaacggauucuucgcaacaauggcuugggcugucccaaaaaacgacaacaacaaaacagcaacaaauucauuaacaauagaagugccauacauuuguacagaaggagaagaccaaauuaccguuuggggauuccacucugauaacgaagcccaaauggcaaaacucuauggagacucaaagccucagaaguucaccucaucugccaacggugugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagauaacaaagaaucucaacucuuugagugaacuggaaguaaagaaucuucaaagacuaagcggugccauggaugaacuccacaacgaaauacuagaacuagaugagaaaguggaugaucucagagcugauacaauaagcucgcaaauagaacucgcagucuugcuuuccaaugaaggaauaauaaacagugaggaugagcaucucuuggcgcuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucacuaaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauauuucuugcuccaucugucuauaa

SEQ ID NO: 56949 - RNA, 1758 nt, Artificial Sequence
  hemagglutinin__InfluenzaB__ABL76969
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaagaaccagagggaaacuaugcccaaaaugccucaacugcacagaucuggacguggccuugggcagaccaaaaugcacggggaacauaccuucggcaaaaguuucaauacuccaugaagucagaccuguuacaucugggugcuuuccuauaaugcacgacagaacaaaaauuagacagcugcccaaucuucucagaggauacgaacauaucagguuaucaauucauaacguuaucaaugcagaaaaggcaccaggaggacccuacaaaauuggaaccucagggucuugcccuaacguuaccaauggaaacggauucuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaagcccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgaaaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugucucgacagaauagcugcuggcaccuuugaugcaggagaauuuucucuccccacuuuugauucacugaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuugcuccaucugucuauaa

SEQ ID NO: 56950 - RNA, 1755 nt, Artificial Sequence
  hemagglutinin__InfluenzaB__ABL76980
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguaaaagcggauuuuucgcaacaauggcuugggcugucccaagggacaacaacaaaacagcaacgaauccacuaacuguagaaguaccauacaucuguacaaaagaagaagaccaaauuacuguuuggggguuccauucugauaacaaaacccaaaugaaaaaccucuauggagacucagauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuauuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugcuauggaugaacuccacaacgaaauacucgaguuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56951 - RNA, 1752 nt, Artificial Sequence
  hemagglutinin__InfluenzaB__ABL76991
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguauagggaucacaccuucggcaaaagcuucaauacuccacgaagucagaccuguuacauccgggugcuuuccuauaaugcacgacagaacaaaaaucagacagcuacccaaucuucucagaggauaugaacauaucagauuaucaacccauaacguuaucaacgcagaaagggcaccaggaggacccuacagacuuggaaccucaggaucuugcccuaacguuaccaguagaagcggauucuucgcaacaauggcuugggcugucccaagggacaacaaaacagcaacgaacccacuaacaguagaaguaccauacauuuguacaaaaggagaagaccaaauuacuguuuggggguuccauucugauaacaaaauccaaaugaaaaaccucuauggagacucaaauccucaaaaguucaccucaucugccaauggaauaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugugcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuuaaagcuugccaauggaaccaaauauagaccucccgcaaaacuauuaaaggaaaaggguuucuucggagcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcggcuucuaguuuggcuguaacauugaugauagcuauuuuuauuguuuauauggucuccagagacaauguuucuugcuccaucugucuauag

SEQ ID NO: 56952 - RNA, 1755 nt, Artificial Sequence
  hemagglutinin__InfluenzaB__ABL77002
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaaugugugugggggucacaccuucagcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcuguuccaagggacaacaacaaaacagcaacgaauccacuaacaauagaaguaccacacaucuguacaaaagaagaagaccaaauuacuauuuggggguuccauucugaugacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauaugguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaagggggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuugaugcaggagaauuuucucuucccacuuuugauucacugaauauuacugcugcaucuuuaaaugaugauggauuggauaaccauacuauacugcucuacuacucaacugcugcuucuaguuuagcuguaacauugaugauagcuauuuuuauuguuuauaugaucuccagagacaauguuucuugcuccaucugucuauaa

SEQ ID NO: 56953 - RNA, 1755 nt, Artificial Sequence
  hemagglutinin__InfluenzaB__ABL77013
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguaaaagcggauuuuucgcaacaauggcuugggcugucccaagggacaacaacaaaacagcaacgaauccacuaacuguagaaguaccauacaucuguacaaaagaagaagaccaaauuacuguuuggggguuccauucugauaacaaaaaccaaaugaaaaaccucuauggagacucagauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuauuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugcuauggaugaacuccacaacgaaauacucgaguuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56954 - RNA, 1755 nt, Artificial Sequence
  hemagglutinin__InfluenzaB__ABL77024
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagggggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugaugacaaaacccaaaugaaaaaccucuauggagacucaaauccucaaaaguucaccucaucugcuaauggaauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcaaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56955 - RNA, 1755 nt, Artificial Sequence
  hemagglutinin__InfluenzaB__ABL77035
augaaggcaauaauuguacuacucaugguaguaacauccaaugcagaucgaaucugcacugggauaacaucaucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacaucuggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugaugacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccauaacgaaauacucgaacuggaugagaaaguggaugaucucagagcugacacaauaagcucacagauagaacuugcagucuugcuuuccaacgaaggaauaauaaacagugaagaugagcaucuauuggcacuugagagaaaacuaaagaaaaugcugggucccucugcuguggacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuauucaacugcugcuucuaguuuggcuguaacauugaugauagcuaucuuuauuguuuauaugaucuccagagacaauguuucuugcuccaucugucuauaa

SEQ ID NO: 56956 - RNA, 1755 nt, Artificial Sequence
  hemagglutinin__InfluenzaB__ABL77046
augaaggcaauaauuguacuacucaugguaguaacauccaaugcagaucgaaucugcacugggauaacaucgucaaacucaccucauguggucaaaacagcuacucaaggggaggucaaugugacuggugcgauaccauugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugaugacaaaacccaaaugaaaaaccucuauggagacucaaauccucaaaaguucaccucaucugcuaauggaauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggaucuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugaguuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaagaugcugggucccucugcuauagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56957 - RNA, 1755 nt, Artificial Sequence
  hemagglutinin__InfluenzaB__ABL77057
augaaggcaauaauuguacuacucaugguaguaacauccaaagcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucaaaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaccccaaaugaaaaaccucuauggagacucaaauccucaaaaguucaccucaucugcuaauggaauaaccacacauuauguuucucagauuggcggcuucccggaacaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuccacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacuaaacauuacugcugcaucuuugaaugaugauggauuggauaaccauacuauacugcucuacuacucaacugcugcuuccaguuuggcuguaacauugaugauagcuauuuuuauuguuuauaugaucuccagagacaauguuucuugcuccaucugucuauaa

SEQ ID NO: 56958 - RNA, 1758 nt, Artificial Sequence
  hemagglutinin__InfluenzaB__ABL77068
augaaggcaauaauuguacuacucaugguaguaacauccaaugcagaucgaaucugcacuggaauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaaaugucucaacugcacagaucuggacguggccuugggcagaccaaaaugcacggggaacauaccuucggcaaaaguuucaauacuccaugaaguaagaccuguuacaucugggugcuuuccuauaaugcacgacagaacaaaaauuagacagcugcccaaucuucucagaggauacgaacguaucagguuaucaaaccauaacguuaucaaugcagaaaaagcaccaggaggacccuacaaaauuggaaccucagggucuugcccuaacguuaccaauggaaacggauucuucgcaacaauggcuugggcugucccaaaaaacgaaaacaacaaaacagcaacaaauucacuaacaauagaaguaccauacauuuguacagaaggagaagaccaaauuaccguuuggggguuccacucugauaacgaaaaccaaauggcaaaacucuauggagacucaaagccucagaaguucacuucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuauacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaauaagaucacaaaaaaucucaacucuuugagugagcuggaaguaaagaaucuucaaagacuaagcggagccauggaugaacuccacaacgaaauacuagaacuagaugagaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucacuaaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuuguuccaucugucuauaa

SEQ ID NO: 56959 - RNA, 1758 nt, Artificial Sequence
  hemagglutinin__InfluenzaB__ABL77090
augaaggcaauaauuguacuacucaugguaguaacauccaaugcagaucgaaucugcacuggaauaacaucgucaaacucaccccauguggucaaaacugcuacucaaggggaagucaaugugacuggugugauaccacugacaacaacacucaccaaaucucauuuugcaaaucucaaaggaacaaaaaccagagggaaacuaugcccaaaaugucucaacugcacagaucuggacguggccuugggcagaccaaaaugcacggggaacauaccuucggcaaaaguuucaauacuccaugaaguaagaccuguuacaucugggugcuuuccuauaaugcacgacagaacaaaaauuagacagcugcccaaucuucucagaggauacgaacguaucagguuaucaaaccauaacguuaucaaugcagaaaaagcaccaggaggacccuacaaaauuggaaccucagggucuugcccuaacguuaccaauggaaacggauucuucgcaacaauggcuugggcugucccaaaaaacgaaaacaacaaaacagcaacaaauucacuaacaauagaaguaccauacauuuguacagaaggagaagaccaaauuaccguuuggggguuccacucugauaacgaaauccaaaugguaaaacucuauggagacucaaagccucagaaguucacuucaucugccaacggagugaccacacauuacguuucacagauugguggcuucccaaaucaaauagaagacggaggacuaccacaaagugguagaauuguuguugauuacauggugcaaaaaucuggaaaaacaggaacaauuaccuaucaaagagguauuuuauugccucaaaaaguguggugcgcaaguggcaggagcaagauaauaaaaggauccuugccuuuaauuggagaagcagauugccuccacgaaaaauacgguggauuaaacaaaagcaagccuuacuauacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagaucacaaaaaaucucaacucuuugagugagcuggaaguaaagaaucuucaaagacuaagcggagccauggaugaacuccacaacgaaauacuagaacuagaugagaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucacuaaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuuguuccaucugucuauaa

SEQ ID NO: 56960 - RNA, 1755 nt, Artificial Sequence
  hemagglutinin__InfluenzaB__ABL77101
augaaggcaauaauuguacuacucaugguaguaacauccaaagcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucaaaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugaugacaaaacccaaaugaaaaaccucuauggagacucaaauccucaaaaguucaccucaucugcuaauggaauaaccacacauuauguuucucagauuggcggcuucccggaacaaacagaagacggagggcuaccacaaagcggcagaauuguuguugauuacauggugcaaaaaccugggaaaacaggaacaauugucuaucaaagagggaucuuguugccucaaaagguguggugcgcgaguggcaggagcaaaguaauaaaaggguccuugccuuuaauuggugaagcagauugccuccacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacuaaacauuacugcugcaucuuugaaugaugauggauuggauaaccauacuauacugcucuacuacucaacugcugcuuccaguuuggcuguaacauugaugauagcuauuuuuauuguuuauaugaucuccagagacaauguuucuugcuccaucugucuauaa

SEQ ID NO: 56961 - RNA, 1758 nt, Artificial Sequence
  hemagglutinin__InfluenzaB__ABL77134
augaaggcaauaauuguacuacucaugguaguaacauccaaugcagaucgaaucugcacuggaauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaaaugucucaacugcacagaucuggacguggccuugggcagaccaaaaugcacggggaacauaccuucggcaaaaguuucaauacuccaugaaguaagaccuguuacaucugggugcuuuccuauaaugcacgacagaacaaaaauuagacagcugccuaaucuucucagaggauacgaacguaucagguuaucaaaccauaacguuaucaaugcagaaaaagcaccaggaggacccuacaaaauuggaaccucagggucuugcccuaacguuaccaauggaaacggauucuucgcaacaauggcuugggcugucccaaaaaacgaaaacaacaaaacagcaacaaauucauuaacaauagaaguaccauacauuuguacagaaggagaagaccaaauuaccguuuggggguuucacucugauaacgaagcccaaauggcaaaacucuauggagacucaaagccucagaaguucacuucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuauacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagaucacaaaaaaucucaacucuuugagugagcuggaaguaaagaaucuucaaagacuaagcggagccauggaugaacuccacaacgaaauacuagaacuagaugagaaaguggaugaucucagagcugauacaauaagcucgcaaauagaacucgcagucuugcuuucuaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucacuaaauauuacugcugcaucuuuaaaugacgauggauuggauaaucauacuauacugcuuuacuacgcaacugcugcuuccaguuuggcuguaacauugaugauagcuaucuuuguuguuuauauggucuccagagacaauguuucuuguuccaucugucuauaa

SEQ ID NO: 56962 - RNA, 1758 nt, Artificial Sequence
  hemagglutinin__InfluenzaB__ABL77145
augaaggcaauaauuguacuacucaugguaguaacauccaaugcagaucgaaucugcacuggaauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaaaugucucaacugcacagaucuggacguggccuugggcagaccaaaaugcacggggaacauaccuucggcaaaaguuucaauacuccaugaaguaagaccuguuacaucugggugcuuuccuauaaugcacgacagaacaaaaauuagacagcugcccaaucuucucagaggauacgaacguaucagguuaucaaaccauaacguuaucaaugcagaagaagcaccaggaggacccuacaaaauuggaaccucagggucuugcccuaacguuaccaauggaaacggauucuucgcaacaauggcuugggcugucccaaaaaacgaaaacaacaaaacagcaacaaauucauuaacaauagaaguaccauacauuuguacagaaggagaagaccaaauuaccguuuggggguuccacucugauagcgaaacccaaauggcaaaacucuauggagacucaaagccucagaaauucacuucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuauacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagaucacaaaaaaucucaacucuuugagugagcuggaaguaaagaaucuucaaagacuaagcggagccauggaugaacuccacaacgaaauacuagaacuagaugagaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacauaagugcaaccagaccugccucgacagaauagcugcuggcaccuuuaaugcaggagaauuuucucuccccaccuuugauucacuaaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuuguuccaucugucuauaa

SEQ ID NO: 56963 - RNA, 1755 nt, Artificial Sequence
  hemagglutinin__InfluenzaB__ABL77156
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagaugacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauaggccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugaacaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacaucacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 56964 - RNA, 1758 nt, Artificial Sequence
  hemagglutinin__InfluenzaB__ABL77178
augaaggcaauaauuguacuacucaugguaguaacauccaaugcagaucgaaucugcacuggaauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaaaugucucaacugcacagaucuggacguggccuugggcagaccaaaaugcacggggaacauaccuucggcaaaaguuucaauacuccaugaaguaagaccuguuacaucugggugcuuuccuauaaugcacgacagaacaaaaauuagacagcugcccaaucuucucagaggauacgaacguaucagguuaucaaaccauaacguuaucaaugcagaaaaagcaccaggaggacccuacaaaauuggaaccucagggucuugcccuaacguuaccaauggaaacggauucuucgcaacaauggcuugggcugucccaaaaaacgaaaacaacaaaacagcaacaaauucauuaacaauagaaguaccauacauuuguacagaaggagaagaccaaauuaccguuuggggguuccacucugauagcgaaacccaaauggcaaaacucuauggagacucaaagccucagaaguucacuucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuauacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagaucacaaaaaaucucaacucuuugagugagcuggaaguaaagaaucuucaaagacuaagcggagccauggaugaacuccacaacgaaauacuagaacuagaugagaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugccucgauagaauagcugcuggcaccuuuaaugcaggagaauuuucucuccccaccuuugauucacuaaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuuguuccaucugucuauaa

SEQ ID NO: 56965 - RNA, 1755 nt, Artificial Sequence
  hemagglutinin__InfluenzaB__ABL77189
augaaggcaauaauuguacuacucaugguaguaacauccaaugcagaucgaaucugcacugggauaacaucuucaaacucaccucauguggucaaaacagcuacucaaggggaagucaaugugacuggugugauaccacugacaacaacaccaacaaaaucuuauuuugcaaaucucaaaggaacaaggaccagagggaaacuaugcccagacugucucaacuguacagaucuggauguggccuugggcauaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaauccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaagggauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 56966 - RNA, 1758 nt, Artificial Sequence
  hemagglutinin__InfluenzaB__ABL77200
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcauggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaauucaccucaucugccaacggagugaccacacauuacguuucacagauugguggcuucccaaaucaaacagaagacggaggacuaccacaaagugguagaauuguuguugauuacauggugcaaaaaucugggaaagcaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgggaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccaaaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56967 - RNA, 1755 nt, Artificial Sequence
  hemagglutinin__InfluenzaB__ABL77222
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauagcaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 56968 - RNA, 1758 nt, Artificial Sequence
  hemagglutinin__InfluenzaB__ABL77233
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaagcccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuaggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56969 - RNA, 1758 nt, Artificial Sequence
  hemagglutinin__InfluenzaB__ABL77244
augaaggcaauaauuguacuacucaugguaguaacauccaaugcagaucgaaucugcacugggauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaagugucucaacugcacagaucuggacguggccuugggcagaccaaagugcacggggaccauaccuucggcaaaagcuucaauacuccacgaagucaaaccuguuacaucugggugcuuuccuauaaugcacgacagaacaaaaauuagacagcuacccaaucuucucagaggauacgaacauaucagguuaucaacccauaacguuaucaacgcagaaacggcaccaggaggacccuacaaaguuggaaccucagggucuugcccuaacguuaccaauggaaacggauucuucgcaacaauggcuugggcugucccaaaaaacgacaacaacaaaacagcaacaaauccauuaacaguagaaguaccauacauuuguacagaaggagaagaccaaauuacuguuuggggguuccacucugauaacgaagcccaaaugguaaaacucuauggagacucaaagccucagaaguucaccucaucugccaacggagugaccacacauuacguuucacagauugguggcuucccaaaucaagcagaagacggagggcuaccacaaagcgguagaauuguuguugauuacauggugcaaaaaucuggaaaaacaggaacaauuaccuaccaaagagguauuuuauugccucaaaaaguguggugcgcaaguggcaggagcaagguaauaaaaggguccuugccuuuaauuggcgaagcagauugccuccacgaaaaauacgguggauuaaacaaaagcaagccuuacuacacaggggaacaugcaaaagccauaggaaauugcccaauaugggugaaaacacccuugaagcuggccaauggaaccaaauauagaccuccugcaaaacuauuaaaggaaaaggguuucuucggagcuauugcugguuucuuagaaggaggaugggaaggaaugauugcagguuggcacggauacacaucccauggagcacauggaguagcaguggcagcagaccuuaagaguacgcaagaagccauaaacaagauaacaaaaaaucucaauucuuugagugagcuggaaguaaagaaucuucaaagacuaagcggugccauggaugaacuccacaacaaaauacucgaacuggaugagaaaguggaugaucucagagcugauacaauaagcucgcaaauagagcucgcagucuugcuuuccaacgaaggaauaauaaacagugaagaugagcaucucuuggcgcuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucacuaaauauuacugcugcaucuuuaaaugaugauggauuggauaaucauacuauacugcuuuacuacucaacugcugcuuccaguuuggcuguaacauugaugauagcuaucuuuauuguuuauauggucuccagagacaauguuucuugcuccaucugucuauaa

SEQ ID NO: 56970 - RNA, 1752 nt, Artificial Sequence
  hemagglutinin__InfluenzaB__ABL77255
augaaggcaauaauuguacuacucaugguaguaacauccaacgcagaucgaaucugcacugggauaacaucuucaaacucaccucauguggucaaaacagcuacucaaggggaaguuaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguauggggaccauaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccauaacguuaucaacgcagaaagggcaccaggaggacccuacagacuuggaaccucaggaucuugcccuaacguuaccaguagaaacggauucuucgcaacaauggcuugggcugucccaagggacaacaaaacagcaacgaauccacuaacaguagaaguaccauacauuugcacaaaaggagaagaccaaauuacuguuuggggguuccauucugaugacaaaacccaaaugaaaaaccucuauggagacucaaauccucaaaaguucaccucaucugccaauggaguaaccacacauuauguuucucagauuggugacuucccaaaucaaacagaagacggagggcuaccacaaagcggcagaauuguuguugauuacauggugcaaaaaccugggaaaacaggaacaauugucuaucaaagagguguuuuguugccucaaaagguguggugcgcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagagggaggaugggaaggaaugauugcagguuggcacggauacacaucucauggagcacauggaguggcaguggcagcagaccuuaagagcacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggccguaacauugaugauagcuauuuuuauuguuuauauggucuccagagacaauguuucuugcuccaucugucuauaa

SEQ ID NO: 56971 - RNA, 1752 nt, Artificial Sequence
  hemagglutinin__InfluenzaB__ABL77266
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucuaaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaaugcagaaagagcaccaggaggacccuacagacuuggaaccucaggaucuugcccuaacguuaccaguagagacggauucuucgcaacaauggcuugggcugucccaagggacaacaaaacagcaacgaauccacuaacaguagaaguaccauacauuuguacaaaaggagaagaccaaauuacuguuuggggguuccauucugauagcaaaacccaaaugaaaaaccucuauggagacucaaauccucaaaaguucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugcgcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauaa

SEQ ID NO: 56972 - RNA, 1752 nt, Artificial Sequence
  hemagglutinin__InfluenzaB__ABL77277
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucuaaaaggaacaaagaccagagggaaacuaugcccaaacugucucaacugcacagaucuggauguggccuugggcagaccaauguguguggggaacacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaacgcagaaagagcaccaggaggacccuacagacuuggaaccucaggaucuugcccuaacguuaccaauagagacggauucuucgcaacaauggcuugggcugucccaagggacaacaaaacagcaacgaauccacuaacaguagaaguaccauacauuuguacaaaaggagaagaccaaauuacuguuuggggguuccauucugauaacaaaauccaaaugaaaaaccucuauggagacucaaauccucaaaaguucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugcgcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugcuaauggaaccaaauauagaccuccugcaaaacuauuaaaggaaagagguuucuucggagcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggacgaucucagagcugacacaauaagcucgcaaauagagcuugcagucuugcuuucuaacgaaggaauaauaaacagugaagaugagcaucuauuggcacuugagagaaaacuaaagaaaaugcugggucccucugcuguagacauagggaauggaugcuucgaaaccaaacacaagugcaaccagacaugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauaa

SEQ ID NO: 56973 - RNA, 1752 nt, Artificial Sequence
  hemagglutinin__InfluenzaB__ABL77288
augaaggcaauaauuguacuacucaugguaguaacauccaacgcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuccucagaggauaugaacauaucagauuaucaacccaaaacguuaucaacgcagaaaaggcaccaggaggacccuacaaacuuggaaccucaggaucuugcccuaacgcuaccaguagaagcggauucuucgcaacaauggcuugggcugucccaagggacaacaaaacagcaacgaauccacuaacaguagaaguaccauacauuuguacaaaaggagaagaccaaauuacuguuuggggguuccauucugauaccaaaacccaaaugaaaaaccucuauggagacucaaauccucaaaaguucaccucaucugcuaauggaguaaccacacauuauguuucucagauugguggcuucccagaucaaacagaagacggagggcuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauauggucuccagagacaauguuucuugcuccaucugucuauaa

SEQ ID NO: 56974 - RNA, 1752 nt, Artificial Sequence
  hemagglutinin__InfluenzaB__ABL77299
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguauagggaacauaccuucggcaaaagcuucaauacuccacgaagucagaccuguuacauccgggugcuuuccuauaaugcacgacagaacaaaaaucagacagcuacccaaucuucucagaggauaugaacauaucagauuaucaacccauaacguuaucaacgcagaaagggcaccaggaggacccuacagacuuggaaccucaggaucuugcccuaacguuaccaguagaagcggauucuucgcaacaauggcuugggcugucccaagggacaacaaaacagcaacgaacccacuaacaguagaaguaccauacauuuguacaaaaggagaagaccaaauuacuguuuggggguuccauucugauaacgaaacccaaaugaaaaaccucuauggagacucaaauccucaaaaguucaccucaucugccaauggaauaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugugcaaguggcaggagcaagguaauaaaaggguccuugccuuuaauuggugaagcagauugccuucacgaaaaauacgguggauuaaacaaaaguaagccuuacuacacaggagaacaugcaaaagccauaggaaauugcccaauaugggugaaaacaccuuugaagcuugccaauggaaccaaauauagaccucccgcaaaacuauuaaaggaaagggguuucuucggagcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacgauaagcucgcaaauagagcuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauag

SEQ ID NO: 56975 - RNA, 1752 nt, Artificial Sequence
  hemagglutinin__InfluenzaB__ABL77310
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucucaaaggaacaaagaccagagggaaacuaugcccaaacugucucaacuguacagaucuggauguggccuugggcagaccaauguguauagguaccauaccuucagcaaaagcuucaauacuccacgaagucagaccuguuacauccgggugcuuuccuauaaugcacgacagaacaaaaaucagacagcuacccaaucuucucagaggauaugaacauaucagauuaucaacccauaacguuaucaacgcagaaagggcaccaggaggacccuacagacuuggaaccucaggaucuugcccuaacguuaccaguagaagcggauucuucgcaacaauggcuugggcugucccaagggacaacaaaacagcaacgaacccacuaacaguagaaguaccauacauuuguacaaaaggagaagaccaaauuacuguuuggggguuccauucugauaacaaaaaccaaaugaaaaaccucuauggagacucaaauccucaaaaguucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaaggugugguguguaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccucccgcaaaacuauuaaaggaaagggguuucuucggagcuauugcugguuucuuggaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaaugaaggaauaauaaacagugaagaugagcaucuauuagcacuugaaagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugccgcaucuuuaaaugaugauggauuggauaaucauacuauacugcucuacuacucaacugcugcuucuaguuuggcuguaacauugaugauagcuauuuuuauuguuuauauggucuccagagacaauguuucuuguuccaucugucuauag

SEQ ID NO: 56976 - RNA, 1758 nt, Artificial Sequence
  hemagglutinin__InfluenzaB__ABL77321
augaaggcaauaauuguacuacucaugguaguaacauccaaugcagaucgaaucugcacugggauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaagugucucaacugcacagaucuggacguggccuugggcagaccaaaaugcacggggaccauaccuucggcaaaaguuucaauacuccacgaagucaaaccuguuacaucugggugcuuuccuauaaugcacgacagaacaaaaauuagacagcugcccaaucuucucagaggauacgaacauaucagguuaucaacccauaacguuaucaacgcagaaaaggcaccaggaggacccuacaaaauuggaaccucagggucuugcccuaacauuaccaauggaaacggauucuucgcaacaauggcuugggcugucccaaaaaacgacaacaacaaaacagcaacaaauucauuaacaguagaaguaccauacauuuguacagaaggagaagaccaaauuaccguuuggggguuccacucugauaacgaaacccaaauggcaaaacucuauggagacucaaaaccucagaaguucaccucaucugccaacggagugaccacacauuacguuucacagauugguggcuucccaaaucaagcagaagacggagggcuaccacaaagugguagaauuguuguugauuacauggugcaaaaaucuggaaaaacaggaacaauuaccuaccaaagagguauuuuauugccucaaaaaguguggugcgcaaguggcaggagcaagguaauaaaaggauccuugccuuuaauuggcgaagcagauugccuccacgaaaaauacgguggauuaaacaaaagcaagccuuacuacacaggggaacaugcaaaagccauaggaaauugcccaauaugggugaaaacacccuugaaucuggccaauggaaccaaauauagaccuccugcaaaacuauuaaaagaaagggguuucuucggagcuauugcugguuucuuagaaggaggaugggaaggaaugauugcagguuggcacggauacacaucccauggagcacauggaguagcaguggcagcagaccuuaagaguacacaagaagccauaaacaagauaacaaaaaaucucaacucuuugagugagcuugaaguaaagaaucuucaaagacuaagcggugccauggaugaacuccacaacgaaauacucgaacuggaugagaaaguggaugaucucagagcugacacaauaagcucgcaaauagagcucgcagucuugcuuuccaaugaaggaauaauaaacagcgaagaugagcaucucuuggcacuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucauuaaauauuacugcugcaucuuuaaaugaugauggauuggauaaucauacuauacugcuuuacuacucaacugcugcuuccaguuuggcuguaacauugaugauagcuaucuuuauuguuuauauggucuccagagacaauguuucuugcuccaucugucuauaa

SEQ ID NO: 56977 - RNA, 1755 nt, Artificial Sequence
  hemagglutinin__InfluenzaB__ABL77332
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaacgcagaaaaggcaccaggaggacccuacaaacuuggaaccucaggaucuugcccuaacgcuaccaguagaagcggauuuuucgcaacaauggcuugggcugucccaagggacaacaacaaaacagcaacgaauccacuaacaguagaaguaccauacauuuguacaaaaggagaagaccaaauuacuguuuggggguuccauucugaugacaaaacccaaaugaaaaaccucuauggagacucaaauccucaaaaguucaccucaucugcuaauggaguaaccacacauuauguuucucaaauuggcggcuucccagaucaaacagaagacggagggcuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacgaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccaugcuauacugcucuacuacucaacugcugcuucuaguuuggcuguaacauugaugauagcuauuuuuauuguuuauauggucuccagagacaauguuucuugcuccaucugucuauaa

SEQ ID NO: 56978 - RNA, 1755 nt, Artificial Sequence
  hemagglutinin__InfluenzaB__ABL77343
augaaggcaauaauuguacuacucaugguaguaacauccaaugcagaucgaaucugcacugggauaacaucuucaaacucaccucaugugguuaaaacagcuacucaaggggaggucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguguggggaccacaccuucggcaaaagcuucaauacuccacgaggucagaccuguuacauccgggugcuuuccuauaaugcacgacagaacaaaaaucagacagcugcccaaucuucucagaggauaugaaaauaucagauuaucaacccaaaacguuaucaaugcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccauacauuuguacaaaaggagaagaccaaauuacuguuuggggguuccauucugauaacaaaauccaaaugaaaaaccucuauggagacucaaauccucaaaaguucaccucaucugcuaauggaguaaccacacauuauguuucucagauuggcggcuucccagaucaaacagaagacggagggcuaccacaaagcggcagaauuguuguugacuacauggugcaaaaaccugggaaaacaggaacaauugucuaucaaagagguguuuuguugccucaaaagguguggugcgcgaguggcaggagcaaaguaguaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguagcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaaguucgcaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuccccacuuuugauucacugaauauuacugcugcaucuuuaaaugaugauggauuggacaaccacacuauacugcucuacuacucaacugcugcuucuaguuuggcuguaacauugaugauagcuauuuuuauuguuuauauggucuccagagacaauguuucuugcuccaucugucuauaa

SEQ ID NO: 56979 - RNA, 1755 nt, Artificial Sequence
  hemagglutinin__InfluenzaB__ABL77365
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaacugucucaacugcacagaucuggauguggcuuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaaugcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccauacguuuguacagaaggagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccagaucaagcagaagacggagggcuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuccccacuuuugauucacugaauauuacugcugcaucuuuaaaugaugauggauuggauaaccauacuauacugcuuuacuacucaacugcugcuucuaguuuggcuguaacauugaugauagcuauuuuuauuguuuauauggucuccagagacaauguuucaugcuccaucugucuauaa

SEQ ID NO: 56980 - RNA, 1755 nt, Artificial Sequence
  hemagglutinin__InfluenzaB__ABL84340
augaaggcaauaauuguacuacucaugguaguaacauccaaugcagaucgaaucugcacugggauaacaucgucaaauucaccucauguggucaaaacagcuacucaaggggaagucaaugugacuggugugauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacacuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuauugccucaaaagguguggugcgcgaguggcaggagcaagguaauaaaaggguccuugcccuuaauuggugaagcagauugccuucacgaaaaauacgguggauuaaacaaaagcaagccuuacuacacaggagagcaugcaaaagccauaggaaauugcccaauauggguaaaaacaccuuugaagcuugccaauggaaccaaauauagaccuccugcaaaacuauuaaaggaaagggguuucuucggagcuauugcuggcuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugaaaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaauggugauggauuggauaaccauacuauacugcucuacuacucaacugcugcuucuaguuuggcuguaacauuaaugauagcuauuuuuauuguuuauaugaucuccagagacaauguuucuugcuccaucugucuauaa

SEQ ID NO: 56981 - RNA, 1755 nt, Artificial Sequence; identical to SEQ ID NO: 56902
  hemagglutinin__InfluenzaB__ABN50382

SEQ ID NO: 56982 - RNA, 1755 nt, Artificial Sequence; identical to SEQ ID NO: 56902
  hemagglutinin__InfluenzaB__ABN50393

SEQ ID NO: 56983 - RNA, 1755 nt, Artificial Sequence
  hemagglutinin__InfluenzaB__ABN50404
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaaugugugugggggucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56984 - RNA, 1755 nt, Artificial Sequence
  hemagglutinin__InfluenzaB__ABN50415
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgaugcagaaaaggcaccaggaggacccuacagacuuggaacuucaggaucuugcccuaacgcuaccaguaaaagcggauuuuucgcaacaauggcuugggcugucccaaggggcaacaacaaaacagcaacgaauccacuaacaguagaaguaccacacaucuguacaaaagaagaagaccaaauuacuguuuggggguuccauucugauaacaaaacucaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56985 - RNA, 1755 nt, Artificial Sequence
  hemagglutinin__InfluenzaB__ABN50426
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgaugcagaaaaggcaccaggaggacccuacagacuuggaacuucaggaucuugcccuaacgcuaccaguaaaagcggauuuuucgcaacaauggcuugggcugucccaaggggcaacaacaaaacagcaacgaauccacuaacaguagaaguaccacacaucuguacaaaagaagaagaccaaauuacuguuuggggguuccauucugauaacaaaacucaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuucauuguuuauaugaucuccagagacaauguuucuugcuccaucugucuauaa

SEQ ID NO: 56986 - RNA, 1755 nt, Artificial Sequence
  hemagglutinin__InfluenzaB__ABN50437
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggagggcccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacccaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaccaaagagguguuuuguugccucaaaagguguggugcgcgaguggcaagagcaaaguaauaaaaggguccuugccucuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuacuggcacuugagagaaaacuaaagaaaaugcugggucccucugcuguagauauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuugaaugaugauggauuggauaaccauacuauacugcucuauuacucaacugcugcuuccaguuuggcuguaacauugaugcuagcuauuuuuauuguuuauauggucuccagagacaacguuucaugcuccaucugucuauaa

SEQ ID NO: 56987 - RNA, 1758 nt, Artificial Sequence
  hemagglutinin__InfluenzaB__ABN50459
augaaggcacuaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaauccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcagaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauga

SEQ ID NO: 56988 - RNA, 1758 nt, Artificial Sequence
  hemagglutinin__InfluenzaB__ABN50470
augaaggcaauaauuguacuacucaugguaguaacauccaaugcagaucgaaucugcacuggaauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaaaugucucaacugcacagaucuggacguggccuugggcagaccaaaaugcacggggaacauaccuucggcaaaaguuucaauacuccaugaaguaagaccuguuacaucugggugcuuuccuauaaugcacgacagaacaaaaauuagacagcugcccaaucuucucagaggauacgaacguaucagguuaucaaaccauaacguuaucaaugcagaaaaagcaccaggaggacccuacaaaauuggaaccucagggucuugcccuaacguuaccaauggaaacggauucuucgcaacaauggcuugggcugucccaaaaaacgaaaacaacaaaacagcaacaaauucauuaacaauagaaguaccauacauuuguacagaaggagaagaccaaauuaccguuuggggguuccacucugauaacgaaauccaaauggcaaaacucuauggagacucaaagccucagaaauucacuucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuauacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagaucacaaaaaaucucaacucuuugagugagcuggaaguaaagaaucuucaaagacuaagcggagccauggaugaacuccacaacgaaauacuagaacuagaugagaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucacuaaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuuguuccaucugucuauaa

SEQ ID NO: 56989 - RNA, 1755 nt, Artificial Sequence
  hemagglutinin__InfluenzaB__ABN50481
augaaggcaauaauuguacuacuccugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56990 - RNA, 1755 nt, Artificial Sequence
  hemagglutinin__InfluenzaB__ABN50503
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaaugugugugggggucacaccuucggcaaaagcuucaauacuccacgaagucaggccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaaaggacaacaacaaaacagcaacgaauccacuaacaguagaaguaccacacaucuguacaaaagaagaagaccaaauuacuguuuggggguuccauucugaugacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauag

SEQ ID NO: 56991 - RNA, 1755 nt, Artificial Sequence
  hemagglutinin__InfluenzaB__ABN50514
augaaggcaauaauuguacuacucaugguagcaacauccaaugcagaucgaaucugcacugggauaacaucuucaaacucaccucauguggucaaaacagccacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauauaagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaccccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacgacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 56992 - RNA, 1755 nt, Artificial Sequence
  hemagglutinin__InfluenzaB__ABN50525
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucagcaaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucucaacaauggcuugggcugucccaaaggacaacaacaaaaaugcaacgaacccacuaacaguagaaguaccauacguuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 56993 - RNA, 1758 nt, Artificial Sequence
  hemagglutinin__InfluenzaB__ABN50536
augaaggcaauaauuguacuacucaugguaguaacauccaaugcagaucgaaucugcacuggaauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaaaugucucaacugcacagaucuggacguggccuugggcagaccaaaaugcacggggaacauaccuucggcaaaaguuucaauacuccaugaaguaagaccuguuacaucugggugcuuuccuauaaugcacgacagaacaaaaauuagacagcugcccaaucuucucagaggauacgaacguaucagguuaucaaaccauaacguuaucaaugcagaagaagcaccaggaggacccuacaaaauuggaaccucagggucuugcccuaacguuaccaauggaaacggauucuucgcaacaauggcuugggcugucccaaaaaacgaaaacaacaaaacagcaacaaauucauuaacaauagaaguaccauacauuuguacagaaggagaagaccaaauuaccguuuggggguuccacucugauaacgaaauccaaauggcaaaacucuauggagacucaaagccucagaaauucacuucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuauacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagaucacaaaaaaucucaacucuuugagugagcuggaaguaaagaaucuucaaagacuaagcggagccauggaugaacuccacaacgaaauacuagaacuagaugagaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacauaagugcaaccagaccugccucgacagaauagcugcuggcaccuuuaaugcaggagaauuuucucuccccaccuuugauucacuaaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuuguuccaucugucuauaa

SEQ ID NO: 56994 - RNA, 1758 nt, Artificial Sequence
  hemagglutinin__InfluenzaB__ABN50547
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaacuagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaaucggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaacuuaccguuuggggguuccacucugauaacgaaaaccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56995 - RNA, 1758 nt, Artificial Sequence
  hemagglutinin__InfluenzaB__ABN50558
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacugugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggcagucccaaaaaacgacaacaacaaaacagcaacaaauucauuaacaauagaaguaccauacauuuguacagaaggagaagaccaaauuaccguuuggggguuccacucugauaaagaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacaugaugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56996 - RNA, 1755 nt, Artificial Sequence
  hemagglutinin__InfluenzaB__ABN50569
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacuacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucgacccaaaacguuaucgacgcagaaaaggcaccaggaggacccuacagacuuggaacuucaggaucuugcccuaacgcuaccaguaaaagcggauuuuucgcaacaauggcuugggcugucccaagaggcaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucacuucaucugcuaauggaauaaccacacauuauguuucucagauuggggguuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 56997 - RNA, 1758 nt, Artificial Sequence
  hemagglutinin__InfluenzaB__ABN50580
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagggcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 56998 - RNA, 1758 nt, Artificial Sequence
  hemagglutinin__InfluenzaB__ABN50591
augaaggcaauaauuguacuacucaugguaguaacauccaaugcagaucgaaucugcacuggaauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaaaugucucaacugcacagaucuggacguggccuugggcagaccaaaaugcacggggaacauaccuucggcaaaaguuucaauacuccaugaaguaagaccuguuacaucugggugcuuuccuauaaugcacgacagaacaaaaauuagacagcugcccaaucuucucagaggauacgaacguaucagguuaucaaaccauaacguuaucaaugcagaaaaagcaccaggaggacccuacaaaauuggaaccucagggucuugcccuaacguuaccaauggaaacggauucuucgcaacaauggcuugggcugucccaaaaaacgaaaacaacaaaacagcaacaaauucauuaacaauagaaguaccauacauuuguacagaaggagaagaccaaauuaccguuuggggguuccacucugauaacgaagcccaaauggcaaaacucuauggagacucaaagccucagaaauucacuucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuauacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagaucacaaaaaaucucaacucuuugagugagcuggaaguaaagaaucuucaaagacuaagcggagccauggaugaacuccacaacgaaauacuagaacuagaugagaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucacuaaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuuguuccaucugucuauaa

SEQ ID NO: 56999 - RNA, 1758 nt, Artificial Sequence
  hemagglutinin__InfluenzaB__ABN50602
augaaggcaauaauuguacuacucaugguaguaacauccaaugcagaccgaaucugcacugggauaacaucgucaaacucaccccauguggucaaaacugcuacucaaggggaagucaaugugacugguguaauaccacugacaacaacacccaccaaaucucauuuugcaaaucucaaaggaacaaaaaccagagggaaacuaugcccaaagugucucaacugcacagaucuggacguggccuugggcagaccaaagugcauggggaccauaccuucggcaaaagcuucaauacuccacgaagucaaaccuguuacaucugggugcuuuccuauaaugcacgacagaacaaaaauuagacagcuacccaaucuucucagaggauacgaaaauaucagguuaucaacccacaacguuaucaacgcagaaacggcaccaggaggacccuacaaaauuggaaccucaggaucuugcccuaacauuaccaauggaaacggauucuucgcaacaauggcuugggcugucccaaaaaacgacaacaacaaaacagcaacaaauccauuaacaguagaaguaccauacauuuguacagaaggagaagaccaaauuacuguuuggggguuccacucugauaacgaaacccaaaugguaaaacucuauggagacucaaagccucagaaguucaccucaucugccaacggagugaccgcacauuacguuucacagauugguggcuucccaaaucaagcagaagacggagggcuaccacaaagcgguagaauuguuguugauuacauggugcagaaaucuggaaaaacaggaacaauuaccuaccaaagagguauuuuauugccucaaaaaguguggugcgcaaguggcaggagcaagguaauaaaaggguccuugccuuuaauuggcgaagcagauugccuccacgaaaaauacgguggauuaaacaaaagcaagccuuacuacacaggggagcaugcaaaagccauaggaaauugcccaauaugggugaaaacacccuugaagcuggccaauggaaccaaauauagaccuccugcaaaacuauuaaaggaaagggguuucuucggagcuauugcugguuucuuggaaggaggaugggaaggaaugauugcagguuggcacggauacacaucccauggagcacauggaguagcaguggcagcagaccuuaaaaguacgcaagaagccauaaacaagauaacaaaaaaccucaauucuuugagugagcuagaaguaaagaaucuucaaagacuaagcggugccauggaugaacuccacaacgaaauacucgaacuggaugagaaaguggaugaucucagagcugauacaauaagcucgcaaauagagcuugcagucuugcuuuccaacgaaggaauaauaaacagugaagaugagcaucucuuggcgcuugaaagaaaacugaagaaaaugcugggccccucugcuguagacauagggaauggaugcuucgaaaccaaacacaagugcaaccagaccugccucgacagaauagcugcuggcaccuuuaaugcaggagaguuuucucuucccaccuuugauucacuaaauauuacugcugcaucuuuaaaugaugauggguuggauaaucauacuauacugcuuuacuacucaacugcugcuuccaguuuggcuguaacauugaugauagcuaucuuuauuguuuauauggucuccagagacaauguuucuugcuccaucugucuauaa

SEQ ID NO: 57000 - RNA, 1752 nt, Artificial Sequence
  hemagglutinin__InfluenzaB__ABN50624
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguauagggaccauaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccauaacguuaucaacgcagaaagggcaccaggaggacccuacagacuuggaaccucaggaucuugcccuaacguuaccaguaaaagcggauucuucgcaacaauggcuugggcugucccaagggacaacaaaacagcaacgaacccacuaacaguagaaguaccauacauuuguacaaaaggagaagaccaaauuacuguuuggggguuccauucugauaacaaaaaccaaaugaaaaaccucuauggagacucaaauccucaaaaguucaccucaucugucaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugugcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccucccgcaaaacuauuaaaggaaagggguuucuucggagcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauag

SEQ ID NO: 57001 - RNA, 1752 nt, Artificial Sequence
  hemagglutinin__InfluenzaB__ABN50635
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguauagggaccauaccuucggcaaaagcuucaauacuccacgaagucagaccuguuacauccgggugcuuuccuauaaugcacgacagaacaaaaaucagacagcuacccaaucuucucagaggauaugaacauaucagauuaucaacccauaacguuaucaacgcagaaagggcaccaggaggacccuacagacuuggaaccucaggaucuugcccuaacguuaccaguagaagcggauucuucgcaacaauggcuugggcugucccaagggacaacaaaacagcaacgaacccacuaacaguagaaguaccauacauuuguacaaaaggagaagaccaaauuacuguuuggggguuccauucugauagcaaaacucaaaugaaaaaccucuauggagacucaaauccucaaaaguucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugugcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccucccgcaaaacuauuaaaggaaagggguuucuucggagcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaccucagagcugacacaauaagcucgcaaauagagcuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauag

SEQ ID NO: 57002 - RNA, 1752 nt, Artificial Sequence
  hemagglutinin__InfluenzaB__ABN50646
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucucaaaggaacaaagaccagagggaaacuaugcccaaacugucucaacuguacagaucuggauguggccuugggcagaccaauguguauagggaccauaccuucagcaaaagcuucaauacuccacgaagucagaccuguuacauccgggugcuuuccuauaaugcacgacagaacaaaaaucagacagcuacccaaucuucucagaggauaugaacauaucagauuaucaacccauaacguuaucaacgcagaaagggcaccaggaggacccuacagacuuggaaccucaggaucuugcccuaacguuaccaguagaagcggauucuucgcaacaauggcuugggcugucccaagggacaacaaaacagcaacgaacccacuaacaguagaaguaccauacauuuguacaaaaggagaagaccaaauuacuguuuggggguuccauucugauaacaaaaaccaaaugaaaaaccucuauggagacucaaauccucaaaaguucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugugcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccucccgcaaaacuauuaaaggaaagggguuucuucggagcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaaguaaagaaucuccaaagacuaaguggugccauggaugaacuccacaacgaaauacucgagcuggaugagaaaguggaugaucucagagcugacacaauaagcucgcaaauagagcuugcagucuugcuuuccaaugaaggaauaauaaacagugaagaugagcaucuauuagcacuugaaagaaaacuaaagaaaaugcugggucccucugcuguagacauagggaauggaugcuucgaaaccaaacacaagugcaaccagaccugcuuagacagaauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuuguuccaucugucuauag

SEQ ID NO: 57003 - RNA, 1752 nt, Artificial Sequence
  hemagglutinin__InfluenzaB__ABN50657
augaaggcaauaauuguacuacucaugguaguaacauccaaugcagaucgaaucugcacugggauaacaucuucaaacucaccucauguagucaaaacagcuacucaaggagaggucaaugugacuggugugauaccacugacgacaacaccaacaaaaucucauuuugcaaaucucaaaggaacaaagaccagagggaaacuaugcccaaacugucucaacugcacagaucuggauguggccuugggcagaccaauguguguggggaucacaccuucggcaaaagcuucaauacuccacgaagucagaccuguuacaucugggugcuuuccuauaaugcaugacagaacaaaaaucagacagcuacccaaucuucucagaggauaugaaaacaucagacuaucaacccaaaacguuaucaacgcagaaaaggcaccaggaggacccuacagacuuggaaccucaggaucuugcccuaacguuaccaguagaaccggauucuucgcaacaauggcuugggcugucccaagggacaacaaaacagcaacgaauccacuaacaguagaaguaccauacauuuguacgaaaggagaagaccaaauuacuguuuggggguuccauucugauaacaaaacccaaaugaaaaaccucuauggagauucaaauccucaaaaguucaccucaucugccaauggaguaaccacacauuauguuucucagauugguggcuucccagaucaaacagaagacggaggacuaccacaaagcggcagaauuguuguugauuacauggugcaaaaaccugggaaaacaggaacaauugucuaucaaagagguauuuuguugccucaaaagguguggugcgcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggggcacauggaguggcaguggcagcagaccuuaagaguacgcaagaagccauaaacaagauaacaaaaaaucucaauucuuugagugagcuagaaguaaagaaccuucaaagacuaaguggugccauggaugaacuccacaacgaaauacucgagcuggaugagaaaguggaugaucucagagcugacacaauaagcucgcaaauagagcuugcagucuuacuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuucaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauaa

SEQ ID NO: 57004 - RNA, 1755 nt, Artificial Sequence
  hemagglutinin__InfluenzaB__ABN50679
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaacccacuaacaguagaaguaccauacauuugcacaaaaggagaagaccaaauuacuguuuggggguuccauucugaugacaaaacccaaaugaaaaaccucuauggagacucaaauccucaaaaguuuaccucaucugcuaauggaguaaccacacauuauguuucucagauuggcggcuucccagaucaaacagaagacggagggcuaccacaaagcggcagaauuguuguugauuacauggugcaaaaaccugggaagacaggaacaauugucuaucagagagguguuuugcugccucaaaagguguggugcgcuaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagagcacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugauacaauaagcucgcaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcgguaacauugaugauagcuauuuuuauuguuuauauggucuccagagacaauguuucuugcuccaucugucuauaa

SEQ ID NO: 57005 - RNA, 1755 nt, Artificial Sequence
  hemagglutinin__InfluenzaB__ABN50690
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaaugcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccauacguuuguacagaaggagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccagaucaaacagaagacggagggcuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuccccacuuuugauucacugaauauuacugcugcaucuuuaaaugaugauggauuggauaaccauacuauacugcuuuacuacucaacugcugcuucuaguuuggcuguaacauugaugauagcuauuuuuauuguuuauauggucuccagagacaauguuucaugcuccaucugucuauaa

SEQ ID NO: 57006 - RNA, 1752 nt, Artificial Sequence
  hemagglutinin__InfluenzaB__ABN50701
augaaggcaauaauuguacuacucaugguaguaacauccaaugcagaucgaaucugcacugggauaacaucuucaaacucaccucauguagucaaaacagcuacucaaggggaggucaaugugacuggugugauaccacugacgacaacaccaacaaaaucucauuuugcaaaucucaaaggaacaaagaccagagggaaacuaugcccaaacugucucaacugcacagaucuggauguggccuugggcagaccaauguguguggggaucacaccuucggcaaaagcuucaauacuccacgaagucagaccuguuacauccgggugcuuuccuauaaugcaugacagaacaaaaaucagacagcuacccaaucuucucagaggauaugaaaacaucagacuaucaacccaaaacguuaucaacgcagaaaaggcaccaggaggacccuacagacuuggaaccucaggaucuugcccuaacguuaccaguagaaccggauucuucgcaacaauggcuugggcugucccaagggacaacaaaacagcaacgaauccacuaacaguagaaguaccauacauuuguacgaaaggagaagaccaaauuacuguuuggggguuccauucugauaacaaagcccaaaugaaaaaccucuauggagacucaaauccucaaaaguucaccucaucugccaauggaguaaccacacauuauguuucucagauugguggcuucccagaucaaacagaagacggaggacuaccacaaagcggcagaauuguuguugauuacauggugcaaaaaccugggaaaacaggaacaauugucuaucaaagagguauuuuguugccucaaaagguguggugcgcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggggcacauggaguggcaguggcagcagaccuuaagaguacgcaagaagccauaaacaagauaacaaaaaaucucaauucuuugagugagcuagaaguaaagaaccuucaaagacuaaguggugccauggaugaacuccacaaugaaauacucgagcuggaugagaaaguggaugaucucagagcugacacaauaagcucgcaaauagagcuugcagucuuacuuuccaacgaaggaauaauaaacagugaagaugagcaucuauuggcacuugagagaaaacuaaagaaaaugcugggucccucugcuguagacauagggaauggaugcuucgaaacaaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauaa

SEQ ID NO: 57007 - RNA, 1755 nt, Artificial Sequence
  hemagglutinin__InfluenzaB__ABN50712
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaaugcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccauacguuuguacagaaggagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccagaucaaacagaagacggagggcuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuccccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauauggucuccagagacaauguuucaugcuccaucugucuauaa

SEQ ID NO: 57008 - RNA, 1755 nt, Artificial Sequence
  hemagglutinin__InfluenzaB__ABN50723
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucagaggaacaaagaccagagggaaacuaugcccaaccugucucaacugcacagaucuggauguggccuugggcagaccaauguguguggggaccacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccauacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57009 - RNA, 1755 nt, Artificial Sequence
  hemagglutinin__InfluenzaB__ABN50734
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguagaagcggauuuuucacaacaauggcuugggcugucccaagggacaacaacaaaacagcaacgaauccacuaacaguagaaguaccacacaucuguacaaaagaagaagaccaaauuacuguuuggggguuccauucugaugacaaaacccaaaugaaaaaccucuauggagacucaaauccucaaaaguucaccucaucuacuaauggaauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcaguuuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57010 - RNA, 1758 nt, Artificial Sequence
  hemagglutinin__InfluenzaB__ABN50745
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacauuaccaauggaaacggauuuuucgcaacaauggcuugggccgucccaaaaaacgacaacaacaaaacagcaacaaauucauuaacaauagaaguaccauacauuuguacagaaggagaagaccaaauuacuguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaagcuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccaaaccugucucgacagaauagcugcugguaccuuuaaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57011 - RNA, 1752 nt, Artificial Sequence
  hemagglutinin__InfluenzaB__ABN51184
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguauagggaccauaccuucggcaaaagcuucaauacuccacgaagucaggccuguuacauccgggugcuuuccuauaaugcacgacagaacaaaaaucagacagcuacccaaucuucucagaggauaugaaaauaucagauuaucaacccauaacguuaucaacgcagaaagggcaccaggaggacccuacagacuuggaaccucaggaucuugcccuaacguuaccaguaaaagcggauucuucgcaacaauggcuugggcugucccaagggacaacaaaacagcaacgaacccacuaacaguagaaguaccauacauuuguacaaaaggagaagaccaaauuacuguuuggggguuccauucugauaacaaaauccaaaugaaaaaccucuauggagacucaaauccucaaaaauucacuucaucugccaauggaguaaccacacauuauguuucucagauugguggcuucccaaaucaaacagaggacggagggcuaccacaaagcggcagaauuguuguugauuacauggugcaaaaaccugggaaaacaggaacaauugucuaucaaagagguguuuuguuaccucaaaagguguggugugcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccucccgcaaaacuauuaaaggaaagggguuucuucggagcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauag

SEQ ID NO: 57012 - RNA, 1752 nt, Artificial Sequence
  hemagglutinin__InfluenzaB__ABN51195
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguauagggaccauaccuucggcaaaagcuucaauacuccacgaagucaggccuguuacauccgggugcuuuccuauaaugcacgacagaacaaaaaucagacagcuacccaaucuucucagaggauaugaaaauaucagauuaucaacccauaacguuaucaacgcagaaagggcaccaggaggacccuacagacuuggaaccucaggaucuugcccuaacguuaccaguagaagcggauucuucgcaacaauggcuugggcugucccaagggacaacaaaacagcaacgaacccacuaacaguagaaguaccauacauuuguacaaaaggagaagaccaaauuacuguuuggggguuccauuuugauaacaaaauccaaaugaaaaaccucuauggagacucaaauccucaaaaauucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuauuaccucaaaagguguggugugcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccucccgcaaaacuauuaaaggaaagggguuucuucggagcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauag

SEQ ID NO: 57013 - RNA, 1758 nt, Artificial Sequence
  hemagglutinin__InfluenzaB__ABN58661
augaaggcaauaauuguacuacucaugguaguaacauccaaugcagaucgaaucugcacugggauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaaaugucucaacugcacagaucuggacguggccuugggcagaccaaaaugcacggggaccauaccuucggcaaaaguuucaauacuccaugaagucaaaccuguuacaucugggugcuuuccuauaaugcacgacagaacaaaaauuagacagcugcccaaucuucucagaggauacgaacauaucagguuaucaacccauaacguuaucaacgcagaaaaggcaccaggaggacccuacaaaauuggaaccucagggucuugcccuaacguuaccaauggaaacggauucuucgcaacaauggcuugggcugucccaaaaaacgacaacaacaaaacagcaacaaauucauuaacaguagaaguaccauacauuuguacagaaggagaagaccaaauuaccguuuggggguuccacucugauaacgaaacccaaauggcaaaacucuauggagacucaaagccucagaaguucaccucaucugccaacggagugaccacacauuacguuucacagauugguggcuucccaaaucaagcagaagacggagggcuaccacaaagugguagaauuguuguugauuacauggugcaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauaugguggauuaaacaaaagcaagccuuacuacacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacucgaacuggaugagaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucacuaaauauuacugcugcaucuuuaaaugaugauggauuggauaaucauacuauacugcuuuacuacucaacugcugcuuccaguuuggcuguaacauugaugauagcuaucuuuauuguuuauauggucuccagagacaauguuucuugcuccaucugucuauaa

SEQ ID NO: 57014 - RNA, 1755 nt, Artificial Sequence
  hemagglutinin__InfluenzaB__ABN59445
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuuaggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauauacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57015 - RNA, 1755 nt, Artificial Sequence
  hemagglutinin__InfluenzaB__ABO72377
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuuugaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57016 - RNA, 1755 nt, Artificial Sequence
  hemagglutinin__InfluenzaB__ABR15973
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccugucacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaggacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccauuugucuauaa

SEQ ID NO: 57017 - RNA, 1752 nt, Artificial Sequence
  hemagglutinin__InfluenzaB__ABR15995
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguauagggaucacaccuucggcaaaagcuucaauacuccacgaagucagaccuguuacauccgggugcuuuccuauaaugcacgacagaacaaaaaucagacagcuacccaaucuucucagaggauaugaacauaucagauuaucaacccauaacguuaucaacgcagaaagggcaccaggaggacccuacagacuuggaaccucaggaucuugcccuaacguuaccaguagaagcggauucuucgcaacaauggcuugggcugucccaagggacaacaaaacagcaacgaacccacuaacaguagaaguaccauacauuuguacaaaaggagaagaccaaauuacuguuuggggguuccauucugauuacaaaacccaaaugaaaaaccucuauggagacucaaauccucaaaaguucaccucaucugccaauggaauaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugugcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccucccgcaaaacuauuaaaggaaagggguuucuucggagcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcggcuucuaguuuggcuguaacauugaugauagcuauuuuuauuguuuauauggucuccagagacaauguuucuugcuccaucugucuauag

SEQ ID NO: 57018 - RNA, 1758 nt, Artificial Sequence
  hemagglutinin__InfluenzaB__ABR16017
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuucccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugucuccacgaaaaauacgguggauuaaauaaaagcaagccuuacuacacaggggaacaugcaaaggccauaggaaauugcccaauaugggugaaaacacccuugaaguuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaauuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57019 - RNA, 1758 nt, Artificial Sequence
  hemagglutinin__InfluenzaB__ACA64899
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuucccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugucuccacgaaaaauacgguggauuaaacaaaagcaagccuuacuacacaggggaacaugcaaaggccauaggaaauugcccaauaugggugaaaacacccuugaaguuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaauuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57020 - RNA, 1758 nt, Artificial Sequence
  hemagglutinin__InfluenzaB__ACA64932
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuuucaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaucaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuugauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaaacugaagaaaaugcugggccccucugcuguagagauagggaauggaugcuuugaaaccaaacacaagugcaaccagaccugucucgacaaaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57021 - RNA, 1758 nt, Artificial Sequence
  hemagglutinin__InfluenzaB__ACA64943
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaauucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuauuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaccucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57022 - RNA, 1758 nt, Artificial Sequence
  hemagglutinin__InfluenzaB__ACA64954
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaaccgaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcaugacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaguucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauauugcuuuacuacucaacugcugccuccaguuuggcuguaacauugaugauagcuaucuuuguuguuuauauggucuccagagacaauguuucuugcuccaucugucuauaa

SEQ ID NO: 57023 - RNA, 1758 nt, Artificial Sequence; identical to SEQ ID NO: 57021
  hemagglutinin__InfluenzaB__ACA64965

SEQ ID NO: 57024 - RNA, 1758 nt, Artificial Sequence
  hemagglutinin__InfluenzaB__ACA64998
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugcuucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacugccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57025 - RNA, 1758 nt, Artificial Sequence
  hemagglutinin__InfluenzaB__ACA65020
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuuucaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccauuuggggguuccacucugauaacgagacccaaauggcaaagcucuauggggacucaaagccccagaaguucaccucaucugccaacggggugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagguagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57026 - RNA, 1758 nt, Artificial Sequence; identical to SEQ ID NO: 57024
  hemagglutinin__InfluenzaB__ACA65031

SEQ ID NO: 57027 - RNA, 1758 nt, Artificial Sequence
  hemagglutinin__InfluenzaB__ACA65042
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuuucaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuauuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57028 - RNA, 1758 nt, Artificial Sequence
  hemagglutinin__InfluenzaB__ACA65053
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucguaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaagggggaugggaaggaaugauugcagguuggcacggauacacaucccauggggcacauggaguagcgguggcagcagaccuuaagagcacucaagaggccauaaacaagauaacaaaaaaucucaacucuuuaagugagcuggaagugaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57029 - RNA, 1758 nt, Artificial Sequence
  hemagglutinin__InfluenzaB__ACA65075
augaaggcaauaauuguacuacucaugguaguaacauccaaugcagaucgaaucugcacugggauaacaucgucgaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugacgcuggccaauggaaccaaauauagaccuccugcaaaacuauuaaaggaaagggguuucuucggagcuauugcugguuuuuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57030 - RNA, 1758 nt, Artificial Sequence
  hemagglutinin__InfluenzaB__ACA65086
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuucccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugucuccacgaaaaauacgguggauuaaacaaaagcaagccuuacuacacaggggaacaugcaaaggccauaggaaauugcccaauaugggugaaaacacccuugaaguuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaauuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57031 - RNA, 1758 nt, Artificial Sequence
  hemagglutinin__InfluenzaB__ACA65097
augaaggcaauaauuguacuacucaugguaguaacaucuaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuauuacacaggggaacaugcaaaggccauaggaaauugcccaauaugggugaaaacacccuugaagcuggccaauggaaccaaauauagaccuccugcaaaacuauuaaaggaaagggguuucuucggagcgauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57032 - RNA, 1758 nt, Artificial Sequence
  hemagglutinin__InfluenzaB__ACA96552
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuucccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugucuccacgaaaaauacgguggauuaaacaaaagcaagccuuacuacacaggggaacaugcaaaggccauaggaaauugcccaauaugggugaaaacacccuugaaguuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaauuagacgagaaaguggaugaucucagagcugauacgauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57033 - RNA, 1758 nt, Artificial Sequence
  hemagglutinin__InfluenzaB__ACA96563
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauuggugguuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuuuuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacaggauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57034 - RNA, 1758 nt, Artificial Sequence
  hemagglutinin__InfluenzaB__ACA96574
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaaaguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaagugaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57035 - RNA, 1758 nt, Artificial Sequence; identical to SEQ ID NO: 57021
  hemagglutinin__InfluenzaB__ACA96585

SEQ ID NO: 57036 - RNA, 1758 nt, Artificial Sequence
  hemagglutinin__InfluenzaB__ACA96596
augaaggcaauaauuguacuacucaugguaguaacaucuaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacacaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuauuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauagacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57037 - RNA, 1758 nt, Artificial Sequence
  hemagglutinin__InfluenzaB__ACA96607
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaaccaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguacaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuauacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggguuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57038 - RNA, 1758 nt, Artificial Sequence
  hemagglutinin__InfluenzaB__ACA96618
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaacgcagaaaaugcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuuuucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57039 - RNA, 1758 nt, Artificial Sequence
  hemagglutinin__InfluenzaB__ACA96629
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaauucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuauuacacaggggaacaugcaaaggccauaggaaauugcccaauaugggugaaaacacccuugaagcuggccaauggaaccaaauauagaccuccugcaaaacuauuaaaggaaagggguuuuuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaccucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57040 - RNA, 1758 nt, Artificial Sequence
  hemagglutinin__InfluenzaB__ACA96640
augaaggcaauaauuguacuacucaugguaguaacauccaaugcagaucgaaucugcacugggauaacaucgucaaacucaccacauguugucaaaacugcuacucaaggggagguuaaugugacugguguaauaccacugacaacaacacccaccaaaucucauuuugcaaaucucaaaggaacagaaaccagagggaaacuaugcccaaaaugcuucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacugccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57041 - RNA, 1755 nt, Artificial Sequence
  hemagglutinin__InfluenzaB__ACD56566
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuggauguggccuugggcagaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguugucgaugcagaaaaugcaccaggaggacccuacagacuuggaaccucaggaucuugcccuaacgcuaccaguaaaagcggauuuuuugcaacaauggcuugggcugucccaaaggacaacaacaaaaaugcaacgaacccacuaacaguagaaguaccauacguuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaagauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaauguuucaugcuccaucugucuauaa

SEQ ID NO: 57042 - RNA, 1755 nt, Artificial Sequence
  hemagglutinin__InfluenzaB__ACD56577
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuggauguggccuugggcagaccaaugugugugggaaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaagcccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugaacaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcuuuauuacucaacugcugcuucuaguuuggcuguaacauugaugcuagcuauuuuuauuguuuauauggucuccagagacaacguuucaugcuccaucugucuauaa

SEQ ID NO: 57043 - RNA, 1758 nt, Artificial Sequence; identical to SEQ ID NO: 57024
  hemagglutinin__InfluenzaB__ACF41658

SEQ ID NO: 57044 - RNA, 1758 nt, Artificial Sequence
  hemagglutinin__InfluenzaB__ACF54136
augaaggcaauaauuguacuacucaugguaguaacauccaaugcagaucgaaucugcacugggauaacaucgucaaacucaccacauguugucaaaacugcuacucaaggggagguuaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacaagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauauuucuugcuccaucugucuauaa

SEQ ID NO: 57045 - RNA, 1758 nt, Artificial Sequence
  hemagglutinin__InfluenzaB__ACF54147
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57046 - RNA, 1755 nt, Artificial Sequence
  hemagglutinin__InfluenzaB__ACF54158
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcgguagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaggccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57047 - RNA, 1755 nt, Artificial Sequence
  hemagglutinin__InfluenzaB__ACF54169
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuggauguggccuugggcagaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaaccccaaugaagaaccucuauggagacucaaauccucaaaaguucaccucaucugcuaauggaguaaccacacauuauguuucucagauuggcggcuucccagcucaaacagaagacgaaggaauaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaagcaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57048 - RNA, 1755 nt, Artificial Sequence
  hemagglutinin__InfluenzaB__ACF54180
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuggauguggccuugggcagaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaaccccaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57049 - RNA, 1755 nt, Artificial Sequence
  hemagglutinin__InfluenzaB__ACF54202
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuggauguggccuugggcagaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaagaucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagcucaaacagaagacgaaggacuaccacaaagcggcagaauuguuguugauuacauggugcaaaaaccuagaaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57050 - RNA, 1755 nt, Artificial Sequence
  hemagglutinin__InfluenzaB__ACF54213
augaaggcaauaauuguacuacucaugguaguaacauccaaugcagaucgaaucugcacugggauaacaucuucaaacucaccucauguggucaaaacagccacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacaucugggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagaugacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugcccuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaaaaugagcaucuauuggcacuugagagaaaacuaaagaaaaugcugggucccucugcuguagacauaggaaauggauguuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57051 - RNA, 1758 nt, Artificial Sequence
  hemagglutinin__InfluenzaB__ACF54224
augaaggcaauaauuguacuacucaugguaguaacauccaaugcagaucgaaucugcacugggauaacaucgucaaacucaccucauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucuuccaacggagugaccacacauuacguuucacagauugguggcuucccaaaucaaacggaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaagauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaauucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57052 - RNA, 1755 nt, Artificial Sequence
  hemagglutinin__InfluenzaB__ACF54257
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaagcuaugcccaaccugucucaacugcacagaucuggauguggccuugggcagaccgauguguguggggaucacaccuucggcaaaagcuucaauacuccacgaagucagaccuguuacauccggaugcuuuccuauaaugcacgacagaacgaaaaucagacagcuacccaaucuucucagaggauaugaaaaaaucagauuaucaacccaaaauguuaucgacgcagaaaaggcaccaggaggacccuacagacuuggaacuucaggaucuugcccuaaugcuaccaguaaaagcggauuuuucgcaacaauggcuugggcugucccaagggaaaacaacaaaacagcaacgaauccacuaacaguagaaguaccacacaucuguacaaaagaagaagaccaaauuacuguuuggggguuccauucugauaacaaaccccaaaugaaaaaccucuauggagacucaaauccucaaaaguucaccucaucugcuaauggaauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauaugguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaaaaagaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugauuuccagagacaauguuucuugcuccaucugucuauaa

SEQ ID NO: 57053 - RNA, 1755 nt, Artificial Sequence
  hemagglutinin__InfluenzaB__ACF54268
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagaggaaaacuaugcccaaccugucucaacugcacagaucuggauguggccuugggcagaccgauguguguggggaucacaccuucggcaaaagcuucaauacuccacgaagucagaccuguuacauccggaugcuuuccuauaaugcacgacagaacgaaaaucagacagcuacccaaucuucucagaggauaugaaaaaaucagauuaucaacccaaaauguuaucgacgcagaaaaggcaccaggaggacccuacagacuuggaacuucaggaucuugcccuaaugcuaccaguaaaagcggauuuuucgcaacaauggcuugggcugucccaagggaaaacaacaaaacagcaacgaauccacuaacaguagaaguaccacacaucuguacaaaagaagaagaccaaauuacuguuuggggguuccauucugauaacaaaauccaaaugaaaaaccucuauggagacucaaauccucaaaaguucaccucaucugcuaauggaauaaccacacauuauguuucucagauuggcggcuucccggaccaaacagaggacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauaugguggauuaaacaaaagcaagccuuacuacacaggagaacaugcaaaagccauaggaaauuguccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacugaagaaaaugcugggucccucugcuauagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugauuuccagagacaauguuucuugcuccaucugucuauaa

SEQ ID NO: 57054 - RNA, 1755 nt, Artificial Sequence
  hemagglutinin__InfluenzaB__ACF54279
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccgauguguguggggaucacaccuucggcaaaagcuucaauacuccacgaagucagaccuguuacauccggaugcuuuccuauaaugcacgacagaacgaaaaucagacagcuacccaaucuucucagaggauaugaaaaaaucagauuaucaacccaaaauguuaucgacgcagaaaaggcaccaggaggacccuacagacuuggaacuucaggaucuugcccuaaugcuaccaguaaaagcggauuuuucgcaacaauggcuugggcugucccaagggaaaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauaugguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaaaaagaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugauuuccagagacaauguuucuugcuccaucugucuauaa

SEQ ID NO: 57055 - RNA, 1755 nt, Artificial Sequence
  hemagglutinin__InfluenzaB__ACF54290
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuauguccagacugucucaacuguacagaucuggauguggccuugggcagaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguugucgaugcagaaaaugcaccaggaggacccuacagacuuggaaccucaggaucuugcccuaacgcuaccaguaaaagcggauuuuuugcaacaauggcuugggcugucccaaaggacaacaacaaaaaugcaacgaacccacuaacaguagaaguaccauacguuuguacagaaggggaagaccaaauuacuguuuggggguuccauucagauaaaaaaacccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaagauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaauguuucaugcuccaucugucuauaa

SEQ ID NO: 57056 - RNA, 1758 nt, Artificial Sequence
  hemagglutinin__InfluenzaB__ACF54312
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaaguuagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauagcgaaacccaaauggcaaaacucuauggggacucaaagccccagaaauucaccucaucuuccaacggagugaccacacauuacauuucacagauugguggcuucccaaaucaaacggaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaaaauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaagggauaauaaacagugaagaugagcaucucuuggcgcuugaaagaaagcugaagaaaaugcugggccccucugcuauagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57057 - RNA, 1758 nt, Artificial Sequence
  hemagglutinin__InfluenzaB__ACF54323
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaccuggacguggcauugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucguaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaagcccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggagaacaugcaaaggccauaggaaauugcccaauaugggugaaaacacccuugaagcuggccaauggaaccaaauauagaccuccugcaaaacuacuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaauguugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauauugcuuuacuacucaacugcugccuccaguuuggcuguaacauugaugauagcuaucuuuguuguuuauauggucuccagagacaauguuucuugcuccaucugucuauaa

SEQ ID NO: 57058 - RNA, 1755 nt, Artificial Sequence
  hemagglutinin__InfluenzaB__ACF54345
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagauuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaagcccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugauacaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaagggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57059 - RNA, 1755 nt, Artificial Sequence
  hemagglutinin__InfluenzaB__ACF54367
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacagcaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauagcaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaaugaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugccguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucauguuccaucugucuauaa

SEQ ID NO: 57060 - RNA, 1755 nt, Artificial Sequence
  hemagglutinin__InfluenzaB__ACN32556
augaaggcaauaauuguacuacucaugguaguaacauccaaugcagaucgaaucugcacugggauaacaucgucaaacucaccucauguggucaaaacagcuacucaaggggaggucaaugugacuggcgcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucauuugcuaauggaauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcauggauacacaucucacggagcacauggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57061 - RNA, 1758 nt, Artificial Sequence
  hemagglutinin__InfluenzaB__ACN32567
auggaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaagggacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuugcuccaucugucuauaa

SEQ ID NO: 57062 - RNA, 1758 nt, Artificial Sequence; identical to SEQ ID NO: 57021
  hemagglutinin__InfluenzaB__ACN32578

SEQ ID NO: 57063 - RNA, 1758 nt, Artificial Sequence
  hemagglutinin__InfluenzaB__ACN32589
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuuucaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccauuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57064 - RNA, 1758 nt, Artificial Sequence
  hemagglutinin__InfluenzaB__ACN32600
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuuucaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauugggaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaagacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57065 - RNA, 1758 nt, Artificial Sequence
  hemagglutinin__InfluenzaB__ACN32611
augaaggcaauaauuguacuacucaugguaguaacauccaaugcagaucgaaucugcacugggauaacaucgucgaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugacgcuggccaauggaaccaaauauagaccuccugcaaaacuauuaaaggaaagggguuucuucggagcuauugcugguuuuuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57066 - RNA, 1755 nt, Artificial Sequence
  hemagglutinin__InfluenzaB__ACN32716
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccagcaaaagcggauuuuucgcaacaauggcuugggcugucccaaaggacaacaacaaaaacgcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 57067 - RNA, 1758 nt, Artificial Sequence
  hemagglutinin__InfluenzaB__ACN32771
augaaggcaauaauuguacuacucaugguaguaacauccaaugcagaucgaaucugcacugggauaacaucgucaaacucaccacauguugucaaaacugcuacucaaggggaggucaaugugaccgguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaacgcagaaaaugcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucacacuauacugcuuuacuacucaacugcugccuccaguuuggcuguaacauugaugauagcuaucuuuguuguuuauauggucuccagagacaauguuucuugcuccaucugucuauaa

SEQ ID NO: 57068 - RNA, 1758 nt, Artificial Sequence; identical to SEQ ID NO: 57040
  hemagglutinin__InfluenzaB__ACN32782

SEQ ID NO: 57069 - RNA, 1758 nt, Artificial Sequence
  hemagglutinin__InfluenzaB__ACO05957
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57070 - RNA, 1755 nt, Artificial Sequence
  hemagglutinin__InfluenzaB__ACO05968
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaagggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaagcuauuaaaggaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57071 - RNA, 1755 nt, Artificial Sequence
  hemagglutinin__InfluenzaB__ACO05979
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaagcuauuaaaggaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57072 - RNA, 1755 nt, Artificial Sequence; identical to SEQ ID NO: 57071
  hemagglutinin__InfluenzaB__ACO05990

SEQ ID NO: 57073 - RNA, 1758 nt, Artificial Sequence
  hemagglutinin__InfluenzaB__ACO06001
augaaggcaauaauuguacuacucaugguaguaacauccaaugcagaucgaaucugcacugggauaacaucgucaaacucaccacauguugucaaaacugcuacucaaggggagguuaaugugacuggugugauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagaaccaaauggcaaagcucuauggggacucaaagccccagaaguucaccucauuugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57074 - RNA, 1755 nt, Artificial Sequence
  hemagglutinin__InfluenzaB__ACO06012
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaacgcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57075 - RNA, 1755 nt, Artificial Sequence
  hemagglutinin__InfluenzaB__ACO06023
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggagggugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaacgcaggagaauuuucucuccccacuuuugauucacugaacauuacugcugcaucuuuaaaugaugauggauuggauaaccauaccauacugcucuauuacucaacugcugcuucuaguuuggcuguaacauugaugcuagcuauuuuuauuguuuauauggucuccagagacaacguuucaugcuccaucugucuauaa

SEQ ID NO: 57076 - RNA, 1755 nt, Artificial Sequence
  hemagglutinin__InfluenzaB__ACO06062
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauugacagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57077 - RNA, 1758 nt, Artificial Sequence
  hemagglutinin__InfluenzaB__ACO94661
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucacaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaagugaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57078 - RNA, 1758 nt, Artificial Sequence
  hemagglutinin__InfluenzaB__ACR15622
augaaggcaauaauuguacuacucaugguaguaacauccaaugcagaucgaaucugcacugggauaacaucgucaaacucaccacauguugucaaaacugcuacucaaggggagguuaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57079 - RNA, 1758 nt, Artificial Sequence
  hemagglutinin__InfluenzaB__ACR15633
augaaggcaauaauuguacuacucaugguaguaacauccaaugcagaucgaaucugcacugggauaacaucgucaaacucaccacauguugucaaaacugcuacucaaggggagguuaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuucaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauagcgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuuuuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuugcuccaucugucuauaa

SEQ ID NO: 57080 - RNA, 1755 nt, Artificial Sequence
  hemagglutinin__InfluenzaB__ACR15644
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuggauguggccuugggcagaccaauguguguggggaccacaccuucggcaaaagcuucaauacuccaugaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauucuucgcaacaauggcuugggcugucccaaaggacaacaacaaaaaugcaacgaacccacuaacaguagaaguaccauacguuuguacggaaggggaagaccaaauuacuguuuggggguuccauucagauaacaaaauccaaaugaagaaccucuauggagacucaaauccucaaaaguucaccucaucugcuaauggaguaaccacacauuauguuucucagauuggcggcuucccagcucaaacagaagacggaggacuaccacaaaguggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57081 - RNA, 1758 nt, Artificial Sequence
  hemagglutinin__InfluenzaB__ACR15655
augaaggcaauaauuguacuacucaugguaguaacauccaaugcagaucgaaucugcacugggauaacaucgucaaacucaccacauguugucaaaacugcuacucaaggggagguuaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauagcgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauauuucuugcuccaucugucuauaa

SEQ ID NO: 57082 - RNA, 1758 nt, Artificial Sequence
  hemagglutinin__InfluenzaB__ACR15666
augaaggcaauaauuguacuacucaugguaguaacauccaaugcagaucgaaucugcacugggauaacaucgucaaacucaccacauguugucaaaacugcuacucaaggggagguuaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacaacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugaugacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57083 - RNA, 1758 nt, Artificial Sequence
  hemagglutinin__InfluenzaB__ACR15677
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacauuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaggcccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57084 - RNA, 1755 nt, Artificial Sequence
  hemagglutinin__InfluenzaB__ACR15710
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugccccaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcagaauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaacgcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57085 - RNA, 1755 nt, Artificial Sequence
  hemagglutinin__InfluenzaB__ACR15721
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaaugcagaaaaagcaccaggaggacccuacagacuuggaaccucaggaucuugcccuaacgcuaccaguagaagcggauuuuuugcaacaauggcuugggcugucccaagggacgacaacaaaacagcaacgaauccacuaacaguagaaguaccauacguuuguacagaaggagaagaccaaauuacuguuuggggguuccauucugauaacaaagcccaaaugaaaaaccucuauggagacucaaauccucaaaaguucaccucaucugcuaauggaguaaccacacauuauguuucucagauuggcggcuucccagaucaaacagaagacggagggcuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccauaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuccccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucaugcuccaucugucuauaa

SEQ ID NO: 57086 - RNA, 1758 nt, Artificial Sequence
  hemagglutinin__InfluenzaB__ACR39336
augaaggcaauaauuguacuacucaugguaguaacauccaaugcagaucgaaucugcacugggauaacaucgucaaacucaccacauguugucaaaacugcuacucaaggggagguuaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaggcccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57087 - RNA, 1755 nt, Artificial Sequence
  hemagglutinin__InfluenzaB__AEA51386
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcggaaaaagcaccaggaggacccuacagacuuggaaccucaggaucuugcccuaacgcuaccaguaaaagcggauuuuucgcaacaauggcuugggcugucccaaaggacaacuacaaaaaugcaacgaacccacuaacaguagaaguaccauacauuuguacagaaggggaaggccaaauuacuguuuggggguuccauucagauaacaaaccccaaaugaagaaccucuauggagacucaaauccucaaaaguucaccucaucugcuaguggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaauuacuccacaaaagcuugccaauggaaccacauuuagcccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuuugaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57088 - RNA, 1755 nt, Artificial Sequence
  hemagglutinin__InfluenzaB__AEA51387
augaaggcaauaauuguacuacucaugguaguaacauccaaugcagaucgaaucugcacugagauaacaucuucaaacucaccucuuguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcuacaauggcuugggccgucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccccaaagcggcagaauuguuguugauuacaugaugcaaaaaccugggaaaacaggaccaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaaguauucccacacaggagaccaugcaaaaacccuaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccaccuuugauucauugaacauuacugcugcaucuuuaaaugaugauggauuggauaaccauacuauauugcucuauuacucaacugcugcuucuaguuuggcuguaacauuaauguuagcuauuuuuauuguuuauauggucuccagagacaacguuucaugcuccaucugucuauaa

SEQ ID NO: 57089 - RNA, 1755 nt, Artificial Sequence
  hemagglutinin__InfluenzaB__AEA51388
augaaggcaauaauuguacuacucaugguaguuacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaggcuucaauacuccacgaagucagaccuguuacauccgggugcuuuccuauaaugcacgacagaacaaaaaucaggcaacuacccaaucuucucagaggauaugaaaauauaagguuaucaacccaaaacguuaucgaugcagaaaaagcaccaggaggacccuauagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuccuacacaggagaacaugcaaaagccaaaggaaauugcccaauauggguaaauacaccuuugaagcuugccaauggaaccaaauauagaccuccugcaaaacuauuuaaggaaagggguuucuucggagcuauugcugguuuccuagaaggagguugggaaggaaugauugcagguuggcacggauacacaucucacggagcacauggaguagcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacaaaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57090 - RNA, 1755 nt, Artificial Sequence
  hemagglutinin__InfluenzaB__AEA51389
augaaggcaauaauuguacuacucaugguaguaacauccaaugcagaucgaaucugcacugggauaacaucuucaaucucaccucuuguggacaaaacagcuacucaaggggaggucaaugugacuggugugauaccacugacaacaacaccaacaaaaucuuauuuugcaaaugucaaaggaacaaggaccagagggaaacuaugcccggacugucucaacuguacagaucuggauguggccuugggcaggccaauguguguggggaccacaccuucugcuaaggcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcacaaaaagcaccaggaggacccuacagacuuggaaccucaggaucuugcccuaacgcuaccaguaaaaucggauuuuucgcaacaauggcuugugcugucccaaaggacaacuacaaaaaugcaacgaacccacuaacagucgaaguaccauacauucguacagaaggggaagaccaaauuacuguuuggggguuccauucagauaacaaaacccaaaugaagaaucucuauggagacucaaauccuccaaaguucaccucaucugcuaauggaguaaccacucauuauguuucucaaacuggcgacuuuccagaucaaacagaggacgggggacuacccccaagcggcagaauuguuguugauuacaugaugcaaaaaccugggaaaacaggaacaauugccuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuccccacacuggagaacauacaaaagccauaggaaauugcccaauauggguaaaaacaccuuugaagcuugccaauggaaccaaauauagaccuucugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuuuucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57091 - RNA, 1755 nt, Artificial Sequence
  hemagglutinin__InfluenzaB__AEA51390
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccaccaagcggcagaauuguuguugauuacaugaugcaaaaaccugggaaaacaggaaccauugucuaucaaagaggugguuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaccacccuugaagcuugccaauggaaccaaauauagaccuccugcaaaacucuuuaaggaaagggguuucuucggagcucuugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57092 - RNA, 1758 nt, Artificial Sequence
  hemagglutinin__InfluenzaB__AEA51391
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauuaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugucaacgagacccaaauggcaaagcucuauggggacucaaagccccagaaguucaccucaucugccaacggagugaccacacauuacauuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuuaccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguaccgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57093 - RNA, 1758 nt, Artificial Sequence
  hemagglutinin__InfluenzaB__AEA51392
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagggaccacccauuacguuucacagauuggugguuucccaaaucaaacggaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaaaauauagcuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57094 - RNA, 1755 nt, Artificial Sequence
  hemagglutinin__InfluenzaB__AEA51395
augaaggcaauaauuguacuacucaugguaguaacauccaaugcagaucgaaucugcacugggauaacaucuucaaacucaccucauguggucaaaacagcuacucuaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcuacaauggcuugggccgucccaaaggacaacuacaaaaaugcaacgaacccccuaacaguagaaguaccauacauuuguaccgaaggggaagaccaauuuacuguuuggggguuccauucagauaacauaacccaauugaagaaccucuuuggagacucaaauccucaaagguucaccucaucugcuaauggaguaaccacacauuauguuucucagauuggcgacuucccagaucaaacagaagacggaggacuaccacaaagcggcagaauuguuguugauuacgugaugcaaaaaccugggaaaacaggaacaauugucuaucaaagagguguuuuguugccuccaaaggugugguucgcgaggggcaggagcaaaguaauaaaagggucauugccuuuaauuggugaagcagauugcauucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccaccuuugauucauugaacauuacugcugcaucuuuaaaugaugauggauuggauaaccauacuauauugcucuauuacucaacugcugcuucuaguuuggcuguaacauuaauguuagcuauuuuuauuguuuauauggucuccagagacaacguuucaugcuccaucugucuauaa

SEQ ID NO: 57095 - RNA, 1758 nt, Artificial Sequence
  hemagglutinin__InfluenzaB__AEA51398
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaauguuaccaauggaaucggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcagaagcaagguaauaaaaggauccuugccuuuaauuggagaagcagauugccuccacgaaaaauacgguggauuaaacaaaagcaagucuuacuacacaggggaacaugcaaaggccauaggaaauugcccaauaugggugaagacacccuugaagcuggccaauggaaccaaauauagaccuccugcacaccuaucauacuuuugcgguuucuucggagcuauugcugguuucuuagaaggaggaugggaaggaaugauugcagguuggaacggauacacaucccauggggcacauggaguagcggugguagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57096 - RNA, 1758 nt, Artificial Sequence
  hemagglutinin__InfluenzaB__AEA51399
augaaggcaauaauuguacuacucaugguaguaacauccaaugcagaucgaaucugcacugggauaacagcgucacagucaccaaauauagacaaaucuucuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaauguuaccaauggaaucggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcagaagcaagguaauaaaaggauccuugccuuuaauuggagaagcagauugccuccacgaaaaauacgguggauuaaacaaaagcaagucuuacuacacaggggaacaugcaaaggccauaggaaauugcccaauaugggugaagacacccuugaagcuggccaauggaaccaaauauagaccuccugcacaccuaucauacuuuugcgguuucuucggagcuauugcugguuucuuagaaggaggaugggaaggaaugauugcagguuggaacggauacacaucccauggggcacauggaguagcggugguagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57097 - RNA, 1758 nt, Artificial Sequence
  hemagglutinin__InfluenzaB__AEG21014
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccuccacugcacagaucuggacguggccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaggaccaaauuaccguuuggggguuccacucugauaacgagacccaaauggcaaagcucuauggggacucaaagccccagaaguucaccucaucugccaacggagugaccacacauuacguuucacagauggguggcuucccaaaucaaacagaagacgggggacuaccacaaagugguagaauuguuguugauuacauggugcagaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaauggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugaguuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauag

SEQ ID NO: 57098 - RNA, 1755 nt, Artificial Sequence
  hemagglutinin__InfluenzaB__AEG21015
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcggaaaaagcaccaggaggacccuacagacuuggaaccucaggaucuugcccuaacgcuaccaguaaaaacggauuuuucgcuacaauggcuugggcugucccaaaggacaacuacaaaggugcaacuaacccaaaaacaguagaaguaccauacauuuguacagaaggggaaggccaaauuacuguuuggggguuccauucagauaacaaaccccaaaugaagaaccucuauggagacucaaauccucaaaaguucaccucaucugcuaguggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaauuacuccacaaaagcuugccaauggaaccacauuuagcccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuuugaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57099 - RNA, 1755 nt, Artificial Sequence
  hemagglutinin__InfluenzaB__AEG21016
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggauccugcccuaacgcuaccaguaaaaucggauuuuucgcuacaauggcuugggcugucccaaaggacaacuacaaaagggcaacuaacccaaaaacaguagaaguaccauacauuuguacagaaggggaagaccaaauuacuguuuggggguuccauucagauaacaaaccccaaaugaagaaccccuauggagacucaaauccucaaaaguucaccucaucugcuaguggaguaaccacacauuauguuucucagauuggcgacuucccagaucaaacagaagacggaggacuaccacaaagcggcagaauuguuguugauuacaugaugcaaaagccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuuugaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuuuaa

SEQ ID NO: 57100 - RNA, 1755 nt, Artificial Sequence
  hemagglutinin__InfluenzaB__AEG21017
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaggcuucaauacuccacgaagucagaccuguuacauccgggugcuuuccuauaaugcacgacagaacaaaaaucaggcaacuacccaaucuucucagaggauaugaaaauauaagguuaucaacccaaaacguuaucgaugcagaaaaagcaccaggaggacccuauagacuuggaaccucaggaucuugcccuaacgcuaccaguaaaaucggauuuuucgcuacaauggcuugggccgucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccccaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuccuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguagcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccaccuuugauucauugaacauuacugcugcaucuuuaaaugaugauggauuggauaaccauacuauacugcucuauuacucaacugcugcuucuaguuuggcuguaacauuaauguuagcuauuuuuauuguuuauauggucuccagagacaacguuucaugcuccaucugucuauaa

SEQ ID NO: 57101 - RNA, 1755 nt, Artificial Sequence
  hemagglutinin__InfluenzaB__AEG21018
augaaggcaauaauuguacuacucaugguaguaacauccaaugcagaucgaaucugcacugggauaacaucuucaaucucaccucuuguggacaaaacagcuacucaaggggaggucaaugugacuggugugauaccacugacaacaacaccaacaaaaucuuauuuugcaaaugucaaaggaacaaggaccagagggaaacuaugcccggacugucucaacuguacagaucuggauguggccuugggcaggccaauguguguggggaccacaccuucugcuaaggcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcacaaaaagcaccaggaggacccuacagacuuggaaccucaggaucuugcccuaacgcuaccaguaaaaucggauuuuucgcaacaauggcuugugcugucccaaaggacaacuacaaaaaugcaacgaacccacuaacagucgaaguaccauacauucguacagaaggggaagaccaaauuacuguuuggggguuccauucagauaacaaaacccaaaugaagaaucucuauggagacucaaauccuccaaaguucaccucaucugcuaauggaguaaccacucauuauguuucucaaacuggcgacuuuccagaucaaacagaggacgggggacuacccccaagcggcagaauuguuguugauuacaugaugcaaaaaccugggaaaacaggaccaauugccuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaaguauucccacacaggagaccaugcaaaaacccuaggaaauugcccaauauggguaaaaacaccuuugaagcuugccaauggaaccaaauauagaccuucugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccaccuuugauucauugaacauuacugcugcaucuuuaaaugaugauggauuggauaaccauacuauauugcucuauuacucaacugcugcuucuaguuuggcuguaacauuaaugcuagcuauuuuuauuguuuauauggucuccagagacaacguuucaugcuccaucugucuauaa

SEQ ID NO: 57102 - RNA, 1755 nt, Artificial Sequence
  hemagglutinin__InfluenzaB__AEG21019
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaggcuucaauacuccacgaagucagaccuguuacauccgggugcuuuccuauaaugcacgacagaacaaaaaucaggcaacuacccaaucuucucagaggauaugaaaauauaagguuaucaacccaaaacguuaucgaugcagaaaaagcaccaggaggacccuauagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucaaacuggcgacuuuccagaucaaacagaggacgggggacuacccccaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuccuacacaggagaacaugcaaaagccauaggaaauugcccaauauggguaaaaacaccuuugaagcuugccaauggaaccaaauauagaccuucugcaaaacuauuaaaggaaagggguuucuucggagcuauugcugguuuccuagaaggagguugggaaggaaugauugcagguuggcacggauacacaucucacggagcacauggaguagcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57103 - RNA, 1758 nt, Artificial Sequence
  hemagglutinin__InfluenzaB__AEG21021
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauacugcacgacagaacaaaaauuagacagcugccuaaccuucuccgaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaucaauagaaguaccauacauuuguacagaaggagaagaccaaauuaccguuuggggguuccacucugauaacgagacccaaauggcaaagcucuauggggacucaaagccccagaaguucaccucaucugccaacggaguggccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaaggucauaaaaggauccuugccuuuauuuggagaagcagauugccuccacgaaaaauacgguggauuuaacaaaagcaagccuuacuacacaggggaacaugcaaaggccauaggaaauugcccaauaugggugaaaacacccuugaagcuggccaauggaaccaaauauagaccuccugcaaaacuauucaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57104 - RNA, 1758 nt, Artificial Sequence
  hemagglutinin__InfluenzaB__AEG21022
augaaggcaauaauuguacuacucaugguaguaacauccaaugcagaucgaaucugcacugggauaacaucgucaaacucaccucauguggucaaaacagcuacucaaggggaggucaaugugacuggcgugauaccacugacaacaacacccaccaaaucucauuuugcaaaucucaaaggaacagaaaccagggggaaacuaugcccaaaaugccucaacugcacagaucuggacguagccuugggcagaccaaaaugcacggggaccacaccuucugcaagagcuucaauacuccacgaagucagaccuguuacauccgggugcuuuccuauacugcacgacagaacaaaaauuagacagcugccuaaccuucuccgaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaucaguagaaguaccauacauuuguacagaaggggaagaccaaauuacuguuuggggguuccauucugauaacgagacccaaauggcaaagcucuauggggacucaaagccccagaaguucaccucaucugccaacggaguggccacacauuacguuucacagauugguggcuucccaaaucaaacggaagacgggggacuaccacaaagugguagaauuguuguugauuacauggugcaaaaaucugggaaaacaggaacaauuaccuaucaaagggguauuuuauugccucaaaggggguggugcgcaaguggcaggagcaaggucauaaaaggauccuugccuuuauuuggagaagcagauugccuucaugaaaaauacgguggauuaaacaaaagcaagccuuacuacacaggagaacaugcaaaggccauaggaaauugcccaauaugggugaaaacacccuugaagcuggccaauggaaccaaauauagaccuccugcaaaacuauucaaggaaagggguuucuucggagcuauugcugguuucuuagaaggaggaugggaaggaaugauugcagguuggcacggauacacaucccauggggcacauggaguaccgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57105 - RNA, 1755 nt, Artificial Sequence
  hemagglutinin__InfluenzaB__AEG21023
augaaggcaauaauuguacuacucaugguaguaacauccaaugcagaucgaaucugcacugggauaacaucuucaaacucaccucauguggucaaaacagcuacucuaggggaggucaaugagacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcuacaauggcuugggccgucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguacccacacauuauguuucucaaauuggcgacuucccagauccaaccgaagacggaggacuaccccaaagcggcagaauugguguugauuacaugaugcaaaaaccugggaaaacaggaacaauuguuuaucaaagagguguuuuguugccucaaaagguguggugcgcgaguggcaggagcaaaguaauaaaagggucauuaccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauuucugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugcucagacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuugugguuuauauggucuccagagacaauguuucuugcuccaucugucuauaa

SEQ ID NO: 57106 - RNA, 1758 nt, Artificial Sequence
  hemagglutinin__InfluenzaB__AEG21024
augaaggcaauaauuguacuacucaugguaguaacauccaaugcagaucgaaucugcacugggauaacaucgucaagcucaccacaugucgucaaaacugcuacucaaggggaggucaaugugacuggugugauaccacugacaacaacacccaccaaaucuuauuuugcaaaucucaaaggaacagagaccagagggaaacuaugcccagacugccccaacugcacagaucuagauguggccuugggcagaccaaauugcugggggaacauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucaggaucuugcccuaacguuaccaauggaaacggauuuuucgcaacaauggcuugggccgucccaaaggacgacaaaaacaaugcagcgacccaucuauuaacaauagaaguaccauuuuuuuguacaggaggagaacaccauauugccguguggggguuccccucugauaacgacacccugauggccaagcucuuuggggacucuaauccccagauguucuccucaucugccaacggaacgaccacacauuacguuucacagauugguggcuucccaaaucaaacagaagacggaggacuaccacaaagugguagaauuguuguugauuacauggugcaaaaaucugggaaaacaggaacaauugccuaucaaagagguguuuuguugccucaaaagguguggugcgcaaguggcaggagcaagguaauaaaagggucauugccuuuaauuggagaagcagauugccugcaugaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuugugguuuauauggucuccagagacaauguuucuugcuccaucugucuauaa

SEQ ID NO: 57107 - RNA, 1755 nt, Artificial Sequence
  hemagglutinin__InfluenzaB__AEG21025
augaaggcaauaauuguacuacucaugguaguaacauccaaugcagaucgaaucugcacggggauaacaucuucaaacucaccucauguggucaaaacagcuacucuaggggaggucaaugagacuggugugauaccacugacaacaacaccaacaaaaucuuauuuugcaaaucucaaaggaacaaggacuagagggaaacuaugcccggacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcuacaauggcuugggccgucccaaaggacaacuacaaaaaugcaacgaacccacuaacaguagaaguaccauacauuuguacagaaggggaagaccaaauuacuguuuggggguuccauucagauaucaaaacccaaaugaagaaccucuauggagacucaaauccucaaaaguucaccucaucugcuaauggaguacccacacauuauguuucucaaauuggcgacuucccagauccaaccgaagacggaggacuaccccaaagcggcagaauugguguugauuacaugaugcaaaaaccugggaaaacaggaacaauuguuuaucaaagagguguuuuguugccucaaaagguguggugcgcgaguggcaggagcaaaguaauaaaagggucauuaccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauuucugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugcucagacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuugugguuuauauggucuccagagacaauguuucuugcuccaucugucuauaa

SEQ ID NO: 57108 - RNA, 1758 nt, Artificial Sequence
  hemagglutinin__InfluenzaB__AEG21026
augaaggccaugaugguacuacucaugguaguaacauccaaugcagaucgaaucugcacugggauaacaucgucaaacucaccacaugucgucaaaacugcuacucaaggggaggucaaugugacugguguaauaccccugacaauaacacccaccaaaucucauuuugcaaaucucaaaguaaaagaaaccagagggaaacuaugcccaaaaugccccaacugcacagaucuggacguagccuugggcagaccaaaaugcacggggaaaauacccucggcaagaguuucaauacuccaugaagacacaccuguuacaucugggugcauuccuauaaugcacgacagaacaaaaauuagacagcugccuaaccuucuccgaggauacgaacacaucagguuaucaacucauaacguuaucaaugcagaaagugcaccaggaggacccuacaaaauuggaaccucagggucuugcccuaauguuaccaauggaaucggauuuuucgcaacaauggcuugggccgucccaaaaaacgacaaaaacaaaacagcaacaaauccauuaacaauagaaguaccauacauuuguacagaaggagaagaccaaauuaccguuuggggguuccacuuugauaacgagacccaaauggcaaagcucuauggggacucaaagccccagguguucaccucaucugccaacggagugaaugcagauuucguuucacagauucguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggccgaagcaagguaauaaaagaauccuugccuuuaauuggagaagcauauuuccaacaggaagaguacgguggauuaaacaaaagcaagucuuacuacacugaggaacaugcaaaggccauagggauuugcccaauaugggugaagacacccuugaagcuggccaauaaaaccaaauauagaccuccugcacaccuaucauacuuuugcgguuucuucggagcuauugcugguuucuuagaaggaggaugggaaggaaugauugcagguuggaacggauacacaucccauggggcacauggaguagcggugguagcagaccuuaagagcacucaagaggccauaaacaagauaacaaaaaaucucaacucuuugagugagcuggaaguggagacucuucaaagacuaagcggugccauggaugaacuccacaacgaaauacuagaacuagaugagaaaguugaugaucacagagcugauacaauaagcucacaaauagaacucccagaccagcuuuccaaugauggaagcauaaacagugaagaugaacaucucuuggcgcuugaaagaaagcugaagaaaaugcugggccccucuaauggggacaaagggaguggaggcauugaaaccaaacacaagugcaaccagaccugucucgacagaauagcugcugguaccuuugaugcaggaggauuuucucaccccaccuuugauucaaagaauguuacugcugcaucuuuaaaugacgauggauuggauagugguacuauacugcuuuacuacucaacugaugucuccaauuuggcuguaacagugaugauggguaucuuugucaaguauauggucuccagagacaauguuucuugcuccaucugucuauaa

SEQ ID NO: 57109 - RNA, 1758 nt, Artificial Sequence
  hemagglutinin__InfluenzaB__AEG21027
augaaggcaauaauuguacuacucaugguaguaacauccaaugcagaucgaaucugcacugggauaacaucgucaaacucaccacaugucgucaaaacugcuacucaaggggaggucaaugugacugguguaauaccccugacaauaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaauguuaccaauggaaucggauuuuucgcaacaauggcuugggccgucccaaaaaacgacaaaaacaaaacagcaacaaauccauuaacaauagaaguaccauacauuuguacagaaggagaagaccaaauuaccguuuggggguuccacuuugauaacgagacccaaauggcaaagcucuauggggacucaaagccccagaaguucaccucaucugccaacggagugaaugcagauuucguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcagaagcaagguaauaaaagaauccuugccuuuaauuggagaagcauauuuccaacaggaagaguacgguggauuaaacaaaagcaagucuuacuacacaggggaacaugcaaaggccauaggaaauugcccaauaugggugaagacacccuugaagcuggccaauggaaccaaauauagaccuccugcacaccuaucauacuuuugcgguuucuucggagcuauugcugguuucuuagaaggaggaugggaaggaaugauugcagguuggaacggauacacaucccauggggcacauggaguagcggugguagcagaccuuaagagcacucaagaggccauaaacaagauaacaaaaaaucucaacucuuugagugagcuggaaguggagacucuucaaagacuaagcggugccauggaugaacuccacaacgaaauacuagaaauagaugagaaaguugaugaucacagagcugauacaauaagcucacaaauagaacucgcaguccugcuuuccaaugaaggaauaauaaacagugaagaugaacaucucuuggcgcuugaaagaaagcugaagaaaaugcugggccccucuaauggggacaaagggaguggaggcauugaaaccaaacacaagugcaaccagaccugucucgacagaauagcugcugguaccuuugaugcaggagaauuuucucuccccaccuuugauucacugaauauuacugcugcaucuuuaaaugacgauggauuggauagugguacuauacugcuuuacuacucaacugaugucuccaauuuggcuguaacagugaugauggguaucuuugucaaguauauggucuccagagacaauguuucuugcuccaucugucuauaa

SEQ ID NO: 57110 - RNA, 1758 nt, Artificial Sequence
  hemagglutinin__InfluenzaB__AEG21028
augaaggcaauaauuguacuacucaugguaguaacauccaaugcagaucgaaucugcacugggauaacagcgucacagucaccaaauauagacaaaucuucuacucaaggggaggucaaugugaguuguguaauaccacugacaacaacacccaccaaaucucauuuugcaaaucucaaaguaaaagaaaccagagggaaacuaugcccaaaaugccccaacugcacagaucuggacguauccuugggcagaccaaaaugcacggggaaaauacccucggcaagaguuucaauacuccaugaagucagaccuguugcaucggggggcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaauguuaccaauggaaucggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacgcagcaaaaagaccuugcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcagaagcaagguaauaaaaggauccuugccuuuaauuggagaagcagauugccuccacgaaaaauacgguggauuaaacaaaagcaagucuuacuacacaggggaacaugcaaaggccauaggaaauugcccaauaugggugaagacacccuugaagcuggccucucgaacgaugucuaaaacuccugcacaccuaucauacuuuugcgguuucuucggagcuauugcugguuucuuagaaggaggaugggaaggaaugauugcagguuggaacggauacacaucccauggggcacauggaguagcggugguagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57111 - RNA, 1758 nt, Artificial Sequence
  hemagglutinin__InfluenzaB__AEG21029
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaauguuaccaauggaaucggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacagcgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57112 - RNA, 1758 nt, Artificial Sequence
  hemagglutinin__InfluenzaB__AEO80052
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaaucaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaucagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57113 - RNA, 1758 nt, Artificial Sequence
  hemagglutinin__InfluenzaB__AEO80067
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaacgcagaaaaugcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57114 - RNA, 1755 nt, Artificial Sequence
  hemagglutinin__InfluenzaB__AEO80078
augaaggaaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuguuaaaggaaagggguuucuucggagcuauugcuggcuuccuagaaggaggaugggaaggaaugaucgcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57115 - RNA, 1758 nt, Artificial Sequence
  hemagglutinin__InfluenzaB__AEO80086
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuauguccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacgauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauuaaugauagcuaucuuuguuguuuauauggucuccagagacaauguuucuugcuccaucugucuauaa

SEQ ID NO: 57116 - RNA, 1755 nt, Artificial Sequence
  hemagglutinin__InfluenzaB__AEO80097
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57117 - RNA, 1755 nt, Artificial Sequence
  hemagglutinin__InfluenzaB__AEO80108
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaacccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57118 - RNA, 1758 nt, Artificial Sequence; identical to SEQ ID NO: 57021
  hemagglutinin__InfluenzaB__AEO80145

SEQ ID NO: 57119 - RNA, 1758 nt, Artificial Sequence; identical to SEQ ID NO: 57077
  hemagglutinin__InfluenzaB__AEO80154

SEQ ID NO: 57120 - RNA, 1758 nt, Artificial Sequence
  hemagglutinin__InfluenzaB__AEO80183
augaaggcaauaauuguacuacucaugguaguaacauccaaugcagaucgaaucugcacugggauaacaucgucaaacucaccacauguugucaaaacugcuacucaaggggagguuaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaucgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauagggaauugcccaauaugggugaaaacacccuugaagcuggccaauggaaccaaauauagaccuccagcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57121 - RNA, 1758 nt, Artificial Sequence
  hemagglutinin__InfluenzaB__AEO80194
augaaggcaauaauuguacuacucaugguaguaacauccaaugcagaucgaaucugcacugggauaacaucgucaaacucaccacauguugucaaaacugcuacucaaggggagguuaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaggcccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaagaggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauaugaucuccagagacaauguuucuugcuccaucugucuauaa

SEQ ID NO: 57122 - RNA, 1758 nt, Artificial Sequence
  hemagglutinin__InfluenzaB__AEO80205
augaaggcaauaauuguacuacucaugguaguaacauccaaugcagaucgaaucugcacugggauaacaucgucaaacucaccacauguugucaaaacugcuacucaaggggagguuaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccaaaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57123 - RNA, 1758 nt, Artificial Sequence
  hemagglutinin__InfluenzaB__AEO80216
augaaggcaauaauuguacuacucaugguaguaacauccaaugcagaucgaaucugcacugggauaacaucgucaaacucaccacauguugucaaaacugcuacucaaggggagguuaauguaacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacaccuuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57124 - RNA, 1755 nt, Artificial Sequence
  hemagglutinin__InfluenzaB__AEO80227
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuauguccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaauccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugaucgcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57125 - RNA, 1758 nt, Artificial Sequence; identical to SEQ ID NO: 57086
  hemagglutinin__InfluenzaB__AEO80238

SEQ ID NO: 57126 - RNA, 1758 nt, Artificial Sequence
  hemagglutinin__InfluenzaB__AEP20178
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuuucaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauaugaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57127 - RNA, 1758 nt, Artificial Sequence
  hemagglutinin__InfluenzaB__AEP20189
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuguacugcuuuacuacucaacugcugccuccaguuuggcuguaacauugaugauagcuaucuuuguuguuuauauggucuccagagacaauguuucuugcuccaucugucuauaa

SEQ ID NO: 57128 - RNA, 1758 nt, Artificial Sequence
  hemagglutinin__InfluenzaB__AEP20200
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggagacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57129 - RNA, 1755 nt, Artificial Sequence
  hemagglutinin__InfluenzaB__AEP20211
augaaggcaauaauuguacuacucaugguaguaacauccaaugcagaucgaaucugcacugggauaacaucgucaaacucaccucauguggucaaaacagcuacucaaggggaggucaaugugacuggugcgauaccccugacaacaacaccaacaaaaucucauuuugcaaaucucaaaggaacaaagaccagagggaaacuaugcccaaccugucucaacugcacagaucuggauguggccuugggcaggccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagagaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57130 - RNA, 1755 nt, Artificial Sequence
  hemagglutinin__InfluenzaB__AEP20222
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacgccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccaaacaucuguacaaaagaagaagaccaaauuacuguuuggggguuccauucugauaacaaaacccaaaugaaaaaccucuauggagacccaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagagcacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57131 - RNA, 1755 nt, Artificial Sequence
  hemagglutinin__InfluenzaB__AEP20233
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauuaaugauagcuauuuuuauuguuuauaugaucuccagagacaauguuucuugcuccaucugucuauaa

SEQ ID NO: 57132 - RNA, 1755 nt, Artificial Sequence
  hemagglutinin__InfluenzaB__AEP20244
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaaaaccagagggaaacuaugcccaaccuguuucaacugcaccgaucuggauguggccuugggcagaccaauguguauggggaucacaccuucggcaaaagcuucaauacuccacgaagucagaccuguuacaucaggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccaaggggcaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcucuaucugucuauaa

SEQ ID NO: 57133 - RNA, 1758 nt, Artificial Sequence
  hemagglutinin__InfluenzaB__AEP20255
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggaucuuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuuccuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57134 - RNA, 1758 nt, Artificial Sequence
  hemagglutinin__InfluenzaB__AEP20277
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacaaaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57135 - RNA, 1755 nt, Artificial Sequence
  hemagglutinin__InfluenzaB__AEP20299
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaagaacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57136 - RNA, 1755 nt, Artificial Sequence
  hemagglutinin__InfluenzaB__AEP20310
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggcuuugggcagaccaauguguguggggaccacaccuucugcgaaagcuucaauacuccacgaagucagacccguuacauccgggugcuuuccuauaaugcacgacagaacaaaaaucaggcaacuacccaaucuucucagaggauaugaaaauaucagguuaucaacccaaaauguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccgcacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcucgccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagagcacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuucaaacgaaggaauaauaaacagugaagacgagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuucauuguuuauauggucuccagagacaacguuucaugcuccaucugucuauaa

SEQ ID NO: 57137 - RNA, 1758 nt, Artificial Sequence
  hemagglutinin__InfluenzaB__AEP20332
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucagcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauccauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57138 - RNA, 1755 nt, Artificial Sequence; identical to SEQ ID NO: 57117
  hemagglutinin__InfluenzaB__AEP20343

SEQ ID NO: 57139 - RNA, 1755 nt, Artificial Sequence; identical to SEQ ID NO: 57117
  hemagglutinin__InfluenzaB__AEP20354

SEQ ID NO: 57140 - RNA, 1755 nt, Artificial Sequence; identical to SEQ ID NO: 57117
  hemagglutinin__InfluenzaB__AEP20365

SEQ ID NO: 57141 - RNA, 1755 nt, Artificial Sequence; identical to SEQ ID NO: 57117
  hemagglutinin__InfluenzaB__AEP20376

SEQ ID NO: 57142 - RNA, 1758 nt, Artificial Sequence
  hemagglutinin__InfluenzaB__AEP20398
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggguacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57143 - RNA, 1758 nt, Artificial Sequence
  hemagglutinin__InfluenzaB__AEP20409
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57144 - RNA, 1758 nt, Artificial Sequence
  hemagglutinin__InfluenzaB__AEP20420
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57145 - RNA, 1758 nt, Artificial Sequence; identical to SEQ ID NO: 57143
  hemagglutinin__InfluenzaB__AEP20431

SEQ ID NO: 57146 - RNA, 1758 nt, Artificial Sequence
  hemagglutinin__InfluenzaB__AEP20442
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57147 - RNA, 1758 nt, Artificial Sequence
  hemagglutinin__InfluenzaB__AEP20453
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagagguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaaaaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgauagaauagcugcugguaccuuugaugcaggagaauuuucucuccccaccuuugauucacugaauauuacugcugcaucuuuaaaugacgauggauuagauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57148 - RNA, 1755 nt, Artificial Sequence; identical to SEQ ID NO: 57117
  hemagglutinin__InfluenzaB__AEQ39027

SEQ ID NO: 57149 - RNA, 1758 nt, Artificial Sequence
  hemagglutinin__InfluenzaB__AEQ39260
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuaaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57150 - RNA, 1758 nt, Artificial Sequence
  hemagglutinin__InfluenzaB__AEQ39271
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacacggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuaaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57151 - RNA, 1758 nt, Artificial Sequence
  hemagglutinin__InfluenzaB__AEQ39282
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgaugaauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57152 - RNA, 1758 nt, Artificial Sequence
  hemagglutinin__InfluenzaB__AEQ39315
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagagcucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57153 - RNA, 1758 nt, Artificial Sequence
  hemagglutinin__InfluenzaB__AEQ39326
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57154 - RNA, 1758 nt, Artificial Sequence
  hemagglutinin__InfluenzaB__AEQ39337
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauaugaacauaucagguuaucaacucauaacguuaucaaugcaggaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagaaacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuaaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57155 - RNA, 1758 nt, Artificial Sequence
  hemagglutinin__InfluenzaB__AEQ39348
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuaaauauuacugcugcaucuuuaaaugacgauggauuggauaaucauauuauacugcuuuacuacucaacugcugccuccaguuuggcuguaacacugaugauagcuaucuuuguuguuuauauggucuccagagacaauguuucuugcuccaucugucuauaa

SEQ ID NO: 57156 - RNA, 1758 nt, Artificial Sequence
  hemagglutinin__InfluenzaB__AEQ39359
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugugcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57157 - RNA, 1758 nt, Artificial Sequence
  hemagglutinin__InfluenzaB__AEQ39370
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguugucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacgauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57158 - RNA, 1755 nt, Artificial Sequence
  hemagglutinin__InfluenzaB__AEQ39392
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauacagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57159 - RNA, 1755 nt, Artificial Sequence
  hemagglutinin__InfluenzaB__AEQ39429
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57160 - RNA, 1755 nt, Artificial Sequence
  hemagglutinin__InfluenzaB__AEQ39440
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaaugcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57161 - RNA, 1755 nt, Artificial Sequence
  hemagglutinin__InfluenzaB__AEQ39451
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaauuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57162 - RNA, 1758 nt, Artificial Sequence
  hemagglutinin__InfluenzaB__AEQ39462
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagaggaaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaauaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57163 - RNA, 1758 nt, Artificial Sequence
  hemagglutinin__InfluenzaB__AEQ39484
augaaggcaauaauuguacuacucaugguaguaacauccaaugcagaucgaaucugcacugggauaacaucgucaaacucaccacaugucgucaaaacugcuacucaaggggaggucaauguuacugguguaauaccacugacaacaacacccaccaaaucucacuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguggcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57164 - RNA, 1755 nt, Artificial Sequence; identical to SEQ ID NO: 57129
  hemagglutinin__InfluenzaB__AEQ39506

SEQ ID NO: 57165 - RNA, 1758 nt, Artificial Sequence
  hemagglutinin__InfluenzaB__AEQ39517
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggguacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacaauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57166 - RNA, 1758 nt, Artificial Sequence
  hemagglutinin__InfluenzaB__AER27038
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacaaaaggagaagaccaaauuaccguuuggggguuccacucugauaacgagacccaaauggcaaagcucuauggggacucaaagccccagaaguucaccucaucugccaacggagugaccacgcauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaauagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57167 - RNA, 1758 nt, Artificial Sequence; identical to SEQ ID NO: 57143
  hemagglutinin__InfluenzaB__AER27060

SEQ ID NO: 57168 - RNA, 1758 nt, Artificial Sequence
  hemagglutinin__InfluenzaB__AET10061
augaaggcaauaauuguacuacucaugguaguaacauccaaugcagaucgaaucugcacuggaauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccgaaaugcacggggaacauacccucagcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcaaaaaaugcaccaggaggacccuacaaaauuggaaccucagggucuugcccuaacguuaccaauggaaacggauuuuucgcaacaauggcuugggccgucccaaaaaacgauaaaaacagaacagcaacaaauucauuaacaauagaaguaccauacauuuguaaagaaggagaagaccaaauuaccguuuggggguuccacucugauaacgaaacccaaauggcaaagcucuauggggacucaaagccccagaaauucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuuuggagcuauugcugguuucuuagaaggaggaugggaaggaaugauugcagguuggcacggauacacaucccauggggcacauggaguagcgguggcugcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguggagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57169 - RNA, 1755 nt, Artificial Sequence
  hemagglutinin__InfluenzaB__AET10062
augaaggcaauaauuguacuacucaugguaguaacauccaaugcagaucgaaucugcacugggauaacaucuucaaacucaccccauguggucaaaacagcuacucaaggggaggucaaugugacuggcgugauaccacugacaauaacaccaacaaaaucuuauuuugcgaaccucaaaggaacaaggaccagagggaaacuaugcccggauugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggugacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugagaaauacgguggauuaaacaaaagcaagccuuacuacacaggagaacaugcaaaagccauaggaaacugcccaauauggguaaaaacaccuuugaagcuugccaaugggaccaaauauagaccuccugcaaaacuauuaaaggaaagggguuucuucggggcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57170 - RNA, 1755 nt, Artificial Sequence
  hemagglutinin__InfluenzaB__AET10064
augaaggcaauaauuguacuacucaugguaguaacauccaaugcagaucgaaucugcacugggauaacaucuucaaacucaccucauguggucaaaacagcuacucaaggggaggucaauguaacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuauuuggggguuccauucagauaacaaaacccaaaugaagaaccucuauggagacucaaauccucaaaaguucaccucaucugcuaacggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaagggaucauugccuuuaauuggugaagcagauugccuccaugaaaaauacgguggauuaaacaaaagcaagccuuauuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagagguaaagaaucuucagagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57171 - RNA, 1755 nt, Artificial Sequence
  hemagglutinin__InfluenzaB__AET10065
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguaaagaaggggaagaccaaauuacuguuuggggguuccauucagauaacaaaacccaaaugaaaaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugagaaauacgguggauuaaacaaaagcaagccuuacuacacaggagaacaugcaaaagccauaggaaacugcccaauauggguaaaaacaccuuugaagcuugccaaugggaccaaauauagaccuccugcaaaacuauuaaaggaaagggguuucuucggggcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57172 - RNA, 1755 nt, Artificial Sequence
  hemagglutinin__InfluenzaB__AET10066
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccgacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugagaaauacgguggauuaaacaaaagcaagccuuacuacacaggagaacaugcaaaagccauaggaaacugcccaauauggguaaaaacaccuuugaagcuugccaaugggaccaaauauagaccuccugcaaaacuauuaaaggaaagggguuucuucggggcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57173 - RNA, 1755 nt, Artificial Sequence
  hemagglutinin__InfluenzaB__AET10067
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacagcaacaccaacaaaaucuuauuuugcaaaccucaaaggaacaagaaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugagaaauacgguggauuaaacaaaagcaagccuuacuacacaggagaacaugcaaaagccauaggaaacugcccaauauggguaaaaacaccuuugaagcuugccaaugggaccaaauauagaccuccugcaaaacuauuaaaggaaagggguuucuucggggcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57174 - RNA, 1755 nt, Artificial Sequence
  hemagglutinin__InfluenzaB__AET10068
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacagcaccgacaaaaucuuauuuugcaaaccucaaaggaacaaggaccagagggaaacuaugcccggacugucucaacuguacagaucuggauguggccuugggcaggccaaugugugcggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugagaaauacgguggauuaaacaaaagcaagccuuacuacacaggagaacaugcaaaagccauagggaacugcccaauauggguaaaaacaccuuugaagcuugccaaugggaccaaauauagaccuccugcaaaacuauuaaaggaaagggguuucuucggggcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57175 - RNA, 1755 nt, Artificial Sequence
  hemagglutinin__InfluenzaB__AET10069
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugagaaauacgguggauuaaacaaaagcaagccuuacuacacaggagaacaugcaaaagccauaggaaacugcccaauauggguaaaaacaccuuugaagcuugccaaugggaccaaauauagaccuccugcaaaacuauuaaaggaaagggguuucuucggggcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57176 - RNA, 1758 nt, Artificial Sequence
  hemagglutinin__InfluenzaB__AET10070
augaaggcaauaauuguacuacucaugguaguaacauccaaugcagaucgaaucugcacugggauaacgucgucaaacucaccacaugucgucaaaacugcuacucaaggggaagucaaagugacugguguaauaccacugacaacaacacccaccaaaucucauuuugcaaaucucaaaggaacagaaaccagaggaaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcuuuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuggaaggaggaugggaaggaaugauugcagguuggcacggauacacgucccauggggcacauggaguagcgguggcagcagaccuuaagagcacucaagaggccauaaacaagauaacaaaaaaucuuaacucuuugagugaacuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagaaauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57177 - RNA, 1758 nt, Artificial Sequence
  hemagglutinin__InfluenzaB__AET10071
augaaggcaauaauuguacuacucaugguaguaacauccaaugcagaucgaaucugcacugggauaacgucgucaaacucaccacaugucgucaaaacugcuacucaaggggaagucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacacaaauggcaaagcuuuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuggaaggaggaugggaaggaaugauugcagguuggcacggauacacgucccauggggcacauggaguagcgguggcagcagaccuuaagagcacucaagaggccauaaacaagauaacaaaaaaucuuaacucuuugagugaacuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagaaauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57178 - RNA, 1758 nt, Artificial Sequence
  hemagglutinin__InfluenzaB__AET10072
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcggauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuagaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57179 - RNA, 1755 nt, Artificial Sequence
  hemagglutinin__InfluenzaB__AET10073
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccgacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggaugugaaaauaucagguuaucaacccagaauguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugagaaauacgguggauuaaacaaaagcaagccuuacuacacaggagaacaugcaaaagccauaggaaacugcccaauauggguaaaaacaccuuugaagcuugccaaugggaccaaauauagaccuccugcaaaacuauuaaaggaaagggguuucuucggggcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57180 - RNA, 1758 nt, Artificial Sequence
  hemagglutinin__InfluenzaB__AET10074
augaaggcaauaauuguacuacucaugguaguaacauccaacgcagaucgaaucugcacugggauaacaucgucaaacucaccacaugucgucaaaacugcuacucaaggggaggucaaugugacugguguaauaccacugacaacaacacccacuagaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaucuucuccgaggauacgaacauaucagguuaucaacucauaacguuaucaaugcagaaaaugcaccaggaggacccuacaaaauuggaaccucagggucuugcccuaauguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggagaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuuccuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuagaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57181 - RNA, 1758 nt, Artificial Sequence
  hemagglutinin__InfluenzaB__AET10076
augaaggcaauaauuguacuacucaugguaguaacauccaaugcagaucgaaucugcacugggauaacgucgucaaacucaccacaugucgucaaaacugcuacucaaggggaagucaaugugacugguguaauaccacugacaacaacacccaccaaaucucauuuugcaaaucucaaaggaacagaaaccagaggaaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcuuuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuggaaggaggaugggaaggaaugauugcagguuggcacggauacacgucccauggggcacauggaguagcgguggcagcggaccuuaagagcacucaagaggccauaaacaagauaacaaaaaaucuuaacucuuugagugaacuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagaaauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57182 - RNA, 1758 nt, Artificial Sequence
  hemagglutinin__InfluenzaB__AET10077
augaaggcaauaauuguacuacucaugguaguaacauccaaugcagaucgaaucugcacugggauaacgucgucaaacucaccacaugucgucaaaacugcuacucaaggggaagucaaugugacugguguaauaccacugacaacaacacccaccaaaucucauuuugcaaaucucaaaggaacagaaaccagaggaaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcuuuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuggaaggaggaugggaaggaaugauugcagguuggcacggauacacgucccauggggcacauggaguagcgguggcagcagaccuuaagagcacucaagaggccauaaacaagauaacaaaaaaucuuaacucuuugagugaacuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaagggauaauaaacagugaagaugaacaucucuuggcgcuugaaagaaagcugaagaaaaugcugggccccucugcuguagaaauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacuacuuuacuacucaacugcugccuccaguuuggcuguaacacugaugauagcuaucuuuguuguuuauauggucuccagagacaauguuucuugcuccaucugucuauaa

SEQ ID NO: 57183 - RNA, 1758 nt, Artificial Sequence
  hemagglutinin__InfluenzaB__AET10078
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuucgcaaaucucaaaggaacagaaaccagagggaaacuaugcccaaaaugccucaacugcacagaucuggacguagccuugggcagaccaaaaugcacggggaaaauacccucggcaagaguuucaguacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuauaaaauuggaaccucagggucuugcccuaacguuaccaauggaaacggauuuuucgcaacaauggcuugggccguuccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuacuuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuuaaugcaggagaauuuucucuccccaccuuugauucacugaauauuacugcugcaucuuuaaaugaagauggauuggauaaucaugccauacugcuuuacuacucaacugcugccuccaguuuggcuguaacacugaugauagcuaucuuuguuguuuauauggucuccagagacaauguuucuugcuccaucugucuauaa

SEQ ID NO: 57184 - RNA, 1758 nt, Artificial Sequence
  hemagglutinin__InfluenzaB__AET10079
augaaggcaauaauuguacuacucaugguaguaacauccaaugcagaugggaucugcacugggauaacgucgucaaacucaccacaugucgucaaaacugcuacucaaggggaagucaaugugacugguguaauaccacugacaacaacacccaccaaaucucauuuugcaaaucucaaaggaacagaaaccagagggaaacuaugcccaaaaugccccaacugcacagaucuggacguagccuugggcaggccaaaaugcacggggaaaauacccucggcaagaguuucaauacuccaugaagucaggccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucacaacaauggcuugggccgucccaaaaaacgacaaaaacaaaacagcaacaaauccauuaacaauagaaguaccauacauuuguacagaaggagaagaccaaauuaccguuuggggguuccacucugauaacgagacacaaauggcaaagcuuuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauuguccaauaugggugaagacacccuugaagcuggccaauggaaccaaauauagaccuccugcaaaacuauuaaaggaaagggguuucuucggagcuauugcugguuucuuggaaggaggaugggaaggaaugauugcagguuggcacggauacacgucccauggggcacauggaguagcgguggcagcagaccuuaagagcacucaagaggccauaaacaagauaacaaaaaaucuuaacucuuugagugaacuggaaguagagaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagaaauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57185 - RNA, 1758 nt, Artificial Sequence
  hemagglutinin__InfluenzaB__AET10080
augaaggcaauaauuguacuacucaugguaguaacauccaaugcagaucgaaucugcacugggauaacgucgucaaacucaccacaugucgucaaaacugcuacccaaggggaagucaaugugacugguguaauaccacugacaacaacacccaccaaaucucauuuugcaaaucucaaaggaacagaaaccagaggaaaacuaugcccaaaaugccccaacugcacagaucuagacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcuuuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuggaaggaggaugggaaggaaugauugcagguuggcacggauacacgucccauggggcacauggaguagcgguggcagcagaccuuaagagcacucaagaggccauaaacaagauaacaaaaaaucuuaacucuuugagugaacuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagaaauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57186 - RNA, 1758 nt, Artificial Sequence
  hemagglutinin__InfluenzaB__AET10081
augaaggcaauaauuguacuacucaugguaguaacauccaaugcagaucgaaucugcacugggauaacgucgucaaacucaccacaugucgucaaaacugcuacucaaggggaagucaaugugacugguguaauaccacugacaacaacacccaccaaaucucauuuugcaaaucucaaaggaacagaaaccagaggaaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcuuuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuggaaggaggaugggaaggaaugauugcagguuggcacggauacacgucccauggggcacauggaguagcgguggcagcagaccuuaagagcacucaagaggccauaaacaagauaacaaaaaaucuuaacucuuugagugaacuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaagggauaauaaacagugaagaugaacaucucuuggcgcuugaaagaaagcugaagaaaaugcugggccccucugcuguagaaauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggguuggauaaucauacuauacuacuuuacuacucaacugcugccuccaguuuggcuguaacacugaugauagcuaucuuuguuguuuauauggucuccagagacaauguuucuugcuccaucugucuauaa

SEQ ID NO: 57187 - RNA, 1758 nt, Artificial Sequence
  hemagglutinin__InfluenzaB__AET10082
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugccccaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacuagcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57188 - RNA, 1758 nt, Artificial Sequence
  hemagglutinin__InfluenzaB__AET10083
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaguacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccaaaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57189 - RNA, 1758 nt, Artificial Sequence
  hemagglutinin__InfluenzaB__AET10084
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggcugucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuccaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57190 - RNA, 1758 nt, Artificial Sequence
  hemagglutinin__InfluenzaB__AET10085
augaaggcaauaauuguacuacucaugguaguaacauccaaugcagaucgaaucugcacugggauaacgucgucaaacucaccacaugucgucaaaacugcuacucaaggggaagucaaugugacugguguaauaccacugacaacaacacccaccaaaucucauuuugcaaaucucaaaggaacagaaaccagaggaaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaagugccauacauuuguacagaaggagaagaccaaauuaccguuuggggguuccacucugauaacgagacccaaauggcaaagcuuuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuggaaggaggaugggaaggaaugauugcagguuggcacggauacacgucccauggggcacauggaguagcgguggcagcagaccuuaagagcacucaagaggccauaaacaagauaacaaaaaaucuuaacucuuugagugaacuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaagggauaauaaacagugaagaugaacaucucuuggcgcuugaaagaaagcugaagaaaaugcugggccccucugcuguagaaauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacuacuuuacuacucaacugcugccuccaguuuggcuguaacacugaugauagcuaucuuuguuguuuauauggucuccagagacaauguuucuugcuccaucugucuauaa

SEQ ID NO: 57191 - RNA, 1758 nt, Artificial Sequence
  hemagglutinin__InfluenzaB__AET43124
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57192 - RNA, 1758 nt, Artificial Sequence; identical to SEQ ID NO: 57191
  hemagglutinin__InfluenzaB__AET43135

SEQ ID NO: 57193 - RNA, 1758 nt, Artificial Sequence
  hemagglutinin__InfluenzaB__AET43146
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuuaccuuuaauuggagaagcagauugccuccacgaaaaauacgguggauuaaacaaaagcaagccuuacuacacaggggaacaugcaaaggccauaggaaauugcccaauaugggugaagacaccccugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57194 - RNA, 1758 nt, Artificial Sequence; identical to SEQ ID NO: 57191
  hemagglutinin__InfluenzaB__AET43157

SEQ ID NO: 57195 - RNA, 1758 nt, Artificial Sequence
  hemagglutinin__InfluenzaB__AET43168
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguaaccuugggcagaccaaaaugcacagggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuaaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57196 - RNA, 1758 nt, Artificial Sequence
  hemagglutinin__InfluenzaB__AET43179
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagaaauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57197 - RNA, 1758 nt, Artificial Sequence; identical to SEQ ID NO: 57191
  hemagglutinin__InfluenzaB__AET43190

SEQ ID NO: 57198 - RNA, 1758 nt, Artificial Sequence
  hemagglutinin__InfluenzaB__AET43201
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcaggaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuaaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57199 - RNA, 1758 nt, Artificial Sequence
  hemagglutinin__InfluenzaB__AET43212
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucacuucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57200 - RNA, 1758 nt, Artificial Sequence; identical to SEQ ID NO: 57191
  hemagglutinin__InfluenzaB__AET43223

SEQ ID NO: 57201 - RNA, 1758 nt, Artificial Sequence; identical to SEQ ID NO: 57198
  hemagglutinin__InfluenzaB__AET50943

SEQ ID NO: 57202 - RNA, 1758 nt, Artificial Sequence
  hemagglutinin__InfluenzaB__AET50954
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagagguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57203 - RNA, 1758 nt, Artificial Sequence
  hemagglutinin__InfluenzaB__AET50965
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57204 - RNA, 1758 nt, Artificial Sequence; identical to SEQ ID NO: 57191
  hemagglutinin__InfluenzaB__AET50976

SEQ ID NO: 57205 - RNA, 1758 nt, Artificial Sequence; identical to SEQ ID NO: 57191
  hemagglutinin__InfluenzaB__AET74255

SEQ ID NO: 57206 - RNA, 1758 nt, Artificial Sequence; identical to SEQ ID NO: 57198
  hemagglutinin__InfluenzaB__AET74277

SEQ ID NO: 57207 - RNA, 1758 nt, Artificial Sequence
  hemagglutinin__InfluenzaB__AET74288
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57208 - RNA, 1758 nt, Artificial Sequence
  hemagglutinin__InfluenzaB__AET74299
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguaaccuugggcagaccaaaaugcacagggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaacaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuaaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57209 - RNA, 1758 nt, Artificial Sequence
  hemagglutinin__InfluenzaB__AET74329
augaaggcaauaauuguacuacucaugguaguaacauccaaugcagaucgaaucugcacugggauaacaucaucaaacucaccacaugucgucaaaacugcuacucaaggggaggucaaugugaccgguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaaugacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauauuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57210 - RNA, 1758 nt, Artificial Sequence; identical to SEQ ID NO: 57191
  hemagglutinin__InfluenzaB__AET74340

SEQ ID NO: 57211 - RNA, 1758 nt, Artificial Sequence
  hemagglutinin__InfluenzaB__AET74351
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugacuacauggugcaaaaaucugggaaaacaggaacaauuaccuaucaaagagguauuuuauugccucaaaagguguggugcgcaaguggcaggagcaagguaauaaaaggauccuuaccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugacgcaggagaauuuucucuccccaccuuugauucacuaaauauuacugcugcaucuuuaaauggcgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57212 - RNA, 1758 nt, Artificial Sequence
  hemagglutinin__InfluenzaB__AEY69077
augaaggcaauaauuguacuacucaugguaguaacauccaaugcagaucgaaucugcacugggauaacaucaucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauaccaucggcaagaguuucaauacuccaugaaguaagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaauucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccuucuuuccaaugaaggaauaauaaacagugaagaugaacaucucuuggcgcuugaaagaaagcugaagaaaaugcugggccccucugcuguagagauaggaaauggaugcuuugaaaccaaacacaagugcaaccagaccugucucgacagaauagcugcugguaccuuugaugcaggagaauuuucucuccccaccuuugauucacuaaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57213 - RNA, 1758 nt, Artificial Sequence
  hemagglutinin__InfluenzaB__AFB77676
augaaggcaauaauuguacuacucaugguaguaacauccaaugcagaucggaucugcacugggauaacaucgucaaacucaccacauguagucaaaacugcuacucaaggggaggucaaugugaccgguguaauaccacugacaacaacacccaccaaaucucauuuugcaaaucucaaaggaacagaaaccagggggaaacuauguccaaaaugccucaacugcacagaucuggacguagccuuaggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugugcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57214 - RNA, 1758 nt, Artificial Sequence
  hemagglutinin__InfluenzaB__AFB77677
augaaggcaauaauuguacuacucaugguaguaacauccaaugcagaucggaucugcacugggauaacaucgucaaacucaccacauguagucaaaacugcuacucaaggggaggucaaugugaccgguguaauaccacugacaacaacacccaccaaaucucauuuugcaaaucucaaaggaacagaaaccagggggaaacuaugcccaaaaugcuucaacugcacagaucuggacguagccuuaggcagaccgaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccguacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaagaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57215 - RNA, 1758 nt, Artificial Sequence
  hemagglutinin__InfluenzaB__AFB77678
augaaggcaauaauuguacuacucaugguaguaacauccaaugcagaucggaucugcacugggauaacaucgucaaacucaccacauguagucaaaacugcuacucaaggggaggucaaugugaccgguguaauaccacugacaacaacacccaccaaaucucauuuugcaaaucucaaaggaacagaaaccagggggaaacuauguccaaaaugccucaacugcacagaucuggacguagccuuaggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57216 - RNA, 1758 nt, Artificial Sequence
  hemagglutinin__InfluenzaB__AFB77679
augaaggcaauaauuguacuacucaugguaguaacauccaaugcagaucggaucugcacugggauaacaucgucaaacucaccacauguagucaaaacugcuacucaaggggaggucaaugugaccgguguaauaccacugacaacaacacccaccaaaucucauuuugcaaaucucaaaggaacagaaaccagggggaaacuauguccaaaaugccucaacugcacagaucuggacguagccuuaggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuagaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucuagacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57217 - RNA, 1758 nt, Artificial Sequence
  hemagglutinin__InfluenzaB__AFB77680
augaaggcaauaauuguacuacucaugguaguaacauccaaugcagaucggaucugcacugggauaacaucgucaaacucaccacauguagucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuuaggcagaccaaaaugcacugggaaaauacccucggcaagaguuucaauacuccaugaagucagaccuauuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57218 - RNA, 1758 nt, Artificial Sequence
  hemagglutinin__InfluenzaB__AFB77681
augaaggcaauaauuguacuacucaugguaguaacauccaaugcagaucggaucugcacugggauaacaucgucaaacucaccacauguagucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuuaggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57219 - RNA, 1758 nt, Artificial Sequence
  hemagglutinin__InfluenzaB__AFB77682
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuauguccaaaaugccucaacugcacagaucuggacguagccuugggcagaccaaaaugcacggggaaaauacccucggcaagaguuucaauacuccaugaagucaggccuguuacaucuggguguuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucuucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacacaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57220 - RNA, 1758 nt, Artificial Sequence; identical to SEQ ID NO: 57218
  hemagglutinin__InfluenzaB__AFB77683

SEQ ID NO: 57221 - RNA, 1758 nt, Artificial Sequence; identical to SEQ ID NO: 57218
  hemagglutinin__InfluenzaB__AFB77684

SEQ ID NO: 57222 - RNA, 1758 nt, Artificial Sequence
  hemagglutinin__InfluenzaB__AFB77685
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccgaaaugcacggggaaaacacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacauuucacagauugguggcuucccaaaucaaacagaagacggaggauuaccacaaagugguagaauuguuguugauuacauggugcaaaaaucugagaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauacagaccuccugcaaaacuauuaaaggaaagggguuucuucggagcuauugcugguuucuuagaaggaggaugggaaggaaugauugcagguuggcacggauacacaucccauggagcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagaugagaaaguggaugaucucagagcugauacaauaagcucacaaauagaacucgcaguccugcuuuccaaugaaggaauaauaaacagugaggaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucacacuauacugcuuuacuacucaacugcugccuccaguuuggcuguaacacugaugauagcuaucuuuguuguuuauauggucuccagagacaauguuucuugcuccaucugucuauaa

SEQ ID NO: 57223 - RNA, 1758 nt, Artificial Sequence
  hemagglutinin__InfluenzaB__AFB77686
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuauguccaaaaugccucaacugcacagaucuggacguagccuugggcagaccaaaaugcacggggaaaauacccucggcaagaguuucaauacuccaugaagucaggccuguuacaucuggguguuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucuucugccaacggagugaccacacauuacguuucacagauuaguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacacaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57224 - RNA, 1758 nt, Artificial Sequence
  hemagglutinin__InfluenzaB__AFB77687
augaaggcaauaauuguacuacucaugguaguaacauccaaugcagaucggaucugcacugggauaacaucgucaaacucaccacauguagucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuuaggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucaaguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccguacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaagaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57225 - RNA, 1758 nt, Artificial Sequence
  hemagglutinin__InfluenzaB__AFB77688
augaaggcaauaauuguacuacucaugguaguaacauccaaugcagaucggaucugcacugggauaacaucgucaaacucaccacauguagucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuuaggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaagcacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuaccgcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57226 - RNA, 1758 nt, Artificial Sequence
  hemagglutinin__InfluenzaB__AFB77689
augaaggcaauaauuguacuacucaugguaguaacauccaaugcagaucggaucugcacugggauaacaucgucaaacucaccacauguagucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuuaggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguacaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57227 - RNA, 1758 nt, Artificial Sequence
  hemagglutinin__InfluenzaB__AFB77690
augaaggcaauaauuguacuacucaugguaguaacauccaaugcagaucggaucugcacugggauaacaucgucaaacucaccacauguagucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuuaggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccguuccaaaaaaugacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuuaagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57228 - RNA, 1758 nt, Artificial Sequence
  hemagglutinin__InfluenzaB__AFE00360
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccucagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugccgguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57229 - RNA, 1758 nt, Artificial Sequence
  hemagglutinin__InfluenzaB__AFF18534
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggucccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57230 - RNA, 1758 nt, Artificial Sequence
  hemagglutinin__InfluenzaB__AFF18543
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57231 - RNA, 1758 nt, Artificial Sequence
  hemagglutinin__InfluenzaB__AFG48978
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuuaggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57232 - RNA, 1758 nt, Artificial Sequence; identical to SEQ ID NO: 57231
  hemagglutinin__InfluenzaB__AFG48997

SEQ ID NO: 57233 - RNA, 1758 nt, Artificial Sequence
  hemagglutinin__InfluenzaB__AFG48998
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaauugcacagaucuggacguagccuugggcagaccaaaaugcacgggaaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgaaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguagaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57234 - RNA, 1755 nt, Artificial Sequence
  hemagglutinin__InfluenzaB__AFG49012
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguugaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcuaguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57235 - RNA, 1755 nt, Artificial Sequence
  hemagglutinin__InfluenzaB__AFG49013
augaaggcaauaauuguacuacucaugguaguaacauccaaugcagaucgaaucugcacugggauaacaucuucaaacucaccucauguggucaaaacagcuacucaaggggaagucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucaggccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuuugcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaaggcuaaguggugccauggaugaacuccacaaugaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucccucccuacuuuugauucauugaacauuacugcugcaucuuuaaaugaugauggauuggauaaucauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57236 - RNA, 1755 nt, Artificial Sequence
  hemagglutinin__InfluenzaB__AFH57865
augaaggcaauaauuguacuacucaugguaguaacauccaaugcagaucgaaucugcacugggauaacaucuucaaacucaccucauguggucaaaacagccacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacaucugggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaaccccaaugaagaaccucuauggggacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugcccuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggauguuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57237 - RNA, 1755 nt, Artificial Sequence
  hemagglutinin__InfluenzaB__AFH57876
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaaaccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugccaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57238 - RNA, 1755 nt, Artificial Sequence
  hemagglutinin__InfluenzaB__AFH57942
augaaggcaauaauuguacuacucaugguaguaacauccaaugcagaucgaaucugcacugggauaacaucuucaaauucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaaaccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuacauggucuccagagacaacguuucaugcuccaucugucuauaa

SEQ ID NO: 57239 - RNA, 1752 nt, Artificial Sequence
  hemagglutinin__InfluenzaB__AFH57986
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucuaaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaacgcagaaagagcaccaggaggacccuacagacuuggaaccucaggaucuugcccuaacguuaccaguagagacggauucuucgcaacaauggcuugggcugucccaagggacaacaaaacagcaacgaauccacuaacaguagaaguaccauacauuuguacaaaaggagaagaccaaauuacuguuuggggguuccauucugaugacaaaacccaaaugaaaaaccucuauggagacucaaauccucaaaaguucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugcgcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacagaauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauaa

SEQ ID NO: 57240 - RNA, 1758 nt, Artificial Sequence
  hemagglutinin__InfluenzaB__AFH58249
augaaggcaauaauuguacuacucaugguaguaacauccaaugcagaucgaaucugcacuggaauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaaaugucucaacugcacagaucuggacguggccuugggcagaccaaaaugcacggggaacauaccuccggcaaaaguuucaauacuccaugaaguaagaccuguuacaucugggugcuuuccuauaaugcacgacagaacaaaaauuagacagcugcccaaucuucucagaggauacgaacguaucagguuaucaaaccauaacguuaucaaugcagaagaagcaccaggaggacccuacaaaauuggaaccucagggucuugcccuaacguuaccaauggaaacggauucuucgcaacaauggcuugggcugucccaaaaaacgaaaacaacaaaacagcaacaaauucauuaacaauagaaguaccauacauuuguacagaaggagaagaccaaauuaccguuuggggguuccacucugauagcgaaacccaaauggcaaaacucuauggagacucaaagccucagaaauucacuucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuauacaggggaacaugcaaaagccauaggaaauugcccaauaugggugaaaacacccuugaagcuggccaauggaaccaaauauagaccuccugcaacacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagaucacaaaaaaucucaacucuuugagugagcuggaaguaaagaaucuucaaagacuaagcggagccauggaugaacuccacaacgaaauacuagaacuagaugagaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacauaagugcaaccagaccugccucgacagaauagcugcuggcaccuuuaaugcaggagaauuuucucuccccaccuuugauucacuaaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuuguuccaucugucuauaa

SEQ ID NO: 57241 - RNA, 1758 nt, Artificial Sequence
  hemagglutinin__InfluenzaB__AFH58260
augaaggcaauaauuguacuacucaugguaguaacauccaaugcagaucgaaucugcacugggauaacaucgucaaacucaccucauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaaacucuauggggacucaaagccccagaaguucaccucaucuuccaacggagugaccacacauuacguuucacagauugguggcuucccaaaucaaacggaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaagauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaauucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57242 - RNA, 1755 nt, Artificial Sequence
  hemagglutinin__InfluenzaB__AFH58271
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucaaaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagaugacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57243 - RNA, 1755 nt, Artificial Sequence; identical to SEQ ID NO: 57242
  hemagglutinin__InfluenzaB__AFH58282

SEQ ID NO: 57244 - RNA, 1758 nt, Artificial Sequence
  hemagglutinin__InfluenzaB__AFH58293
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacgacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57245 - RNA, 1755 nt, Artificial Sequence
  hemagglutinin__InfluenzaB__AFH58304
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagaugacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacgggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuuugaaaccaaacacaaaugcaaccagaccugcuuagacaggauagcugcuggcaccuuuaaugcaggagaauuuucucuccccacuuuugauucauugaacaucacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57246 - RNA, 1755 nt, Artificial Sequence; identical to SEQ ID NO: 57245
  hemagglutinin__InfluenzaB__AFH58315

SEQ ID NO: 57247 - RNA, 1755 nt, Artificial Sequence
  hemagglutinin__InfluenzaB__AFH58326
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaagcccaaaugaagaaccucuauggagacucaaauccucaaaaguucaccucaucugcuaauggaguaaccacacauuauguuucucagauuggcgacuucccagaucaaacagaagacggaggaccaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57248 - RNA, 1755 nt, Artificial Sequence
  hemagglutinin__InfluenzaB__AFH58337
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaagcccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57249 - RNA, 1758 nt, Artificial Sequence
  hemagglutinin__InfluenzaB__AFH58348
augaaggcaauaauuguacuacucaugguaguaacauccaaugcagaccgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagaggaaaacuaugcccaaaaugccucaacugcacagaucuggacguggccuugggcagaccaaaaugcacggggaacauaccuucggcaagaguuucaauacuccaugaagucaggccuguuacaucugggugcuuuccuauaaugcacgacagaacaaaaauuagacagcugccuaaccuucucagaggauacgaacauaucagguuaucagcucauaacguuaucaaugcagaaaaugcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaaagaaacccaaauggcaaagcucuauggggacucaaagccccagaaguucaccucaucugccaacggagugaccacacauuacguuucacagauugguggcuucccaaaccaaacagaagauggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugacacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuuaaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57250 - RNA, 1758 nt, Artificial Sequence
  hemagglutinin__InfluenzaB__AFH58370
augaaggcaauaauuguacuacucaugguaguaacauccaaugcagaccgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagaggaaaacuaugcccaaaaugccucaacugcacagaucuggacguggccuugggcagaccaaaaugcacggggaacauaccuucggcaagaguuucaauacuccaugaagucaggccuguuacaucugggugcuuuccuauaaugcacgacagaacaaaaauuagacagcugccuaaccuucucagaggauacgaacauaucagguuaucagcucauaacguuaucaaugcagaaaaugcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaagcucuauggggacucaaagccccagaaguucaccucaucugccaacggagugaccacacauuacguuucacagauugguggcuucccaaaccaaacagaagauggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugacacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuuaaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57251 - RNA, 1758 nt, Artificial Sequence
  hemagglutinin__InfluenzaB__AFH58392
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57252 - RNA, 1758 nt, Artificial Sequence; identical to SEQ ID NO: 57244
  hemagglutinin__InfluenzaB__AFH58403

SEQ ID NO: 57253 - RNA, 1758 nt, Artificial Sequence; identical to SEQ ID NO: 57244
  hemagglutinin__InfluenzaB__AFH58414

SEQ ID NO: 57254 - RNA, 1758 nt, Artificial Sequence; identical to SEQ ID NO: 57244
  hemagglutinin__InfluenzaB__AFH58425

SEQ ID NO: 57255 - RNA, 1758 nt, Artificial Sequence; identical to SEQ ID NO: 57244
  hemagglutinin__InfluenzaB__AFH58436

SEQ ID NO: 57256 - RNA, 1758 nt, Artificial Sequence
  hemagglutinin__InfluenzaB__AFH58458
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauacccucggcaagaguuucaauacuccaugaaguaagaccuguuacaucugggugcuuuccuauaaugcacgacagaacaaaaauuagacagcugcccaaccuucuccgaggauacgaacauaucagguuaucaacuaauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagauccaaauggcaaagcucuauggggacucaaggccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaaguuggccaaugggaccaaauauagaccuccugcaaagcuauuaaaggaaagggguuucuucggagcuauugcugguuucuuagaaggaggaugggaaggaaugauugcagguuggcacggauacacgucccauggggcacauggaguagcgguggcagcagaccuuaagagcacccaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugacacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaaguguaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57257 - RNA, 1758 nt, Artificial Sequence; identical to SEQ ID NO: 57256
  hemagglutinin__InfluenzaB__AFH58469

SEQ ID NO: 57258 - RNA, 1755 nt, Artificial Sequence; identical to SEQ ID NO: 57238
  hemagglutinin__InfluenzaB__AFH58480

SEQ ID NO: 57259 - RNA, 1755 nt, Artificial Sequence
  hemagglutinin__InfluenzaB__AFH58502
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguagaaguaccauacauuuguacagaaggggaagaccaaauuacuguuuggggguuccauucagaugacaaaacccaaaugaagagccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57260 - RNA, 1758 nt, Artificial Sequence
  hemagglutinin__InfluenzaB__AFH58513
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugaugacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57261 - RNA, 1758 nt, Artificial Sequence; identical to SEQ ID NO: 57260
  hemagglutinin__InfluenzaB__AFH58524

SEQ ID NO: 57262 - RNA, 1755 nt, Artificial Sequence
  hemagglutinin__InfluenzaB__AFH58535
augaaggcaauaauuguacuacucaugguaguaacauccaaugcagaucgaaucugcacugggauaacaucgucaaacucaccucaugugguuaaaacugccacucaaggggaagucaaugugacuggugugauaccacuaacaacaacaccuaccaaaucucauuuugcaaaucucaaaggaacacagaccagaggaaaacuaugcccaaacuguuuuaacugcacagaucuggacguggcccugggcagaccaaaaugcauggggaacacacccuccgcaaaagucucaauacuccaugaagucaaaccugcuacaucuggaugcuuuccuauaaugcacgacagaacaaaaaucagacaacuaccuaaucuucucagaggauaugaaaacaucagguuaucaaccaguaauguuaucaauacagagacggcaccaggaggacccuacaagguggggaccucaggaucuugcccuaacguugcuaaugggaacggcuucuucaacacaauggcuuggguuaucccaaaagacaacaacaagacagcaauaaauccaguaacaguagaaguaccauacauuuguucagaaggggaagaccaaauuacuguuuggggguuccacucugaugacaaaacccaaauggaaagacucuauggagacucaaauccucaaaaguucaccucaucugccaauggaguaaccacacauuauguuucucagauugguggcuucccaaaucaaacagaagacgaagggcuaaaacaaagcggcagaauuguuguugauuacaugguacagaaaccuggaaaaacaggaacaauuguuuaucaaagaggcauuuuauugccucaaaaaguguggugcgcaaguggcaggagcaagguaauaaaaggguccuugccuuuaauuggugaagcagauugccuccacgaaaaguacgguggauuaaauaaaagcaagccuuacuacacaggagagcaugcaaaggccauaggaaauugcccaauaugggugaaaacacccuugaagcuggccaauggaaccaaauauagaccgccugcaaaacuauuaaaggaaagagguuucuucggagcuauugcugguuucuuggaaggaggaugggaaggaaugauugcagguuggcacggauacacaucucauggagcacauggaguggcaguggcagcagaccuuaagaguacacaagaagcuauaaacaagauaacaaaaaaucucaacuauuuaagugagcuagaaguaaaaaaccuucaaagacuaagcggagcaaugaaugagcuucacgacgaaauacucgagcuagacgaaaaaguggaugaucuaagagcugauacaauaagcucacaaauagagcuugcagucuugcuuuccaacgaagggauaauaaacagugaagaugagcaucucuuggcacuugaaagaaaacugaagaaaaugcugggccccucugcuguagaaauagggaaugggugcuuugaaaccaaacacaaaugcaaccagacuugccuagacaggauagcugcuggcaccuuuaaugcaggagauuuuucucuucccacuuuugauucauuaaacauuacugcugcaucuuuaaaugaugauggcuuggauaaucauacuauacugcucuacuacucaacugcugcuucuagcuuggcuguaacauuaaugauagcuaucuucauugucuacauggucuccagagacaauguuucuuguuccaucugucuguga

SEQ ID NO: 57263 - RNA, 1752 nt, Artificial Sequence
  hemagglutinin__InfluenzaB__AFH58557
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucuaaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaacgcagaaagagcaccaggaggacccuacagacuuggaaccucaggaucuugcccuaacguuaccaguagagacggauucuucgcaacaauggcuugggcugucccaagggacaacaaaacagcaacgaauccacuaacaguagaaguaccauacauuuguacaaaaggagaagaccaaauuacuguuuggggguuccauucugaugacaaaacccaaaugaaaaaccucuauggagacucaaauccucaaaaguucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugcgcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacagaauagcugcuggcaccuuuaaugcaggagaauuuucuuuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauaa

SEQ ID NO: 57264 - RNA, 1755 nt, Artificial Sequence
  hemagglutinin__InfluenzaB__AFJ76224
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucccauuuugcaaaucucaaaggaacaaagaccagagggaaacuaugcccaaccugucucaacugcacagaccuggauguggccuuaggcaguccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacauagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcggucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57265 - RNA, 1755 nt, Artificial Sequence
  hemagglutinin__InfluenzaB__AFJ76235
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugccucaacugcacagaucuggauguggccuuaggcaguccaauguguguggggaucacaccuucagcaaaagcuucaauacuccacgaagucagaccuguuacauccagaugcuuuccuauaaugcacgacagaacaaaaaucagacagcuacccaaucuucucagaggauaugaaaaaaucagauuaucaacccaaaacguuaucaacauagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucggcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcggucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuucccacuuuugauucacugaauauuacugcugcaucuuuaaaugaugauggauuggauaaccauaccauacugcucuacuacucaacugcugcuucuaguuuggcuguaacauugaugauagcuauuuuuauuguuuauaugaucuccagagacaauguuucuugcuccaucugucuauaa

SEQ ID NO: 57266 - RNA, 1755 nt, Artificial Sequence
  hemagglutinin__InfluenzaB__AFJ76246
augaaggcaauaauuguacuacucaugguaguaacauccaaugcagaucgaaucugcacugggauaacaucgucgaacucaccucauguggucaaaacagcuacucaaggggaggucaaugugacuggugugauaccacuaacaacaacaccaacaaaaucucauuuugcaaaucucaaaggaacaaagaccagagggaaacuaugcccaaccugucucaacugcacagaucuggauguggccuuaggcagcccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacauagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaggaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggacgaucucagagcugacacaauaagcucacaaauagaacuugcggucuugcuuuccaacgaaggaauaauaaacagugaagaugagcaucuauuggcacuugagagaaaacuaaagaaaaugcugggucccucugcuguagacauagggaauggaugcuuugaaaccaaacacaaaugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57267 - RNA, 1758 nt, Artificial Sequence
  hemagglutinin__InfluenzaB__AFJ76268
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauaggccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57268 - RNA, 1758 nt, Artificial Sequence
  hemagglutinin__InfluenzaB__AFJ76301
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauauugcuuuacuacucaacugcugccuccaguuuggcuguaacauugaugauagcuaucuuuguuguuuauauggucuccagagacaauguuucuugcuccaucugucuauaa

SEQ ID NO: 57269 - RNA, 1755 nt, Artificial Sequence
  hemagglutinin__InfluenzaB__AFJ76323
augaaggcaauaauuguacuacucaugguaguaacauccaaugcagaucgaaucugcacugggauaacaucuucaaacucaccucauguggucaaaacagcuacacaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccagcaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57270 - RNA, 1758 nt, Artificial Sequence
  hemagglutinin__InfluenzaB__AFJ76334
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauagcgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggauggaaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcugucuuuguuguuuauauggucuccagagacaauguuucuugcuccaucugucuauaa

SEQ ID NO: 57271 - RNA, 1758 nt, Artificial Sequence; identical to SEQ ID NO: 57267
  hemagglutinin__InfluenzaB__AFJ77327

SEQ ID NO: 57272 - RNA, 1755 nt, Artificial Sequence
  hemagglutinin__InfluenzaB__AFJ77369
augaaggcaauaauuguacuacucaugguaguaacauccaaugcagaucgaaucugcacugggauaacaucuucaaacucaccucauguggucaaaacagcuacucaaggggaggucaaugugaccggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57273 - RNA, 1755 nt, Artificial Sequence
  hemagglutinin__InfluenzaB__AFJ77380
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauauggguuaaaacaccuuugaagcuugccaauggaaccaaauauagaccuccugcaaaacuacuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57274 - RNA, 1755 nt, Artificial Sequence
  hemagglutinin__InfluenzaB__AFJ80139
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuucacgaagucagaccugucacauccggaugcuuuccuauaaugcacgacagaacaaaaaucagacagcuacccaaucuucucagaggauaugaaaaaaucagauuaucaacccagaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaacccacuaacaguagaaguaccauacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguucuugccuuuaauuggugaagcagauugccuucacgaaaaauacggugguuuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguggacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57275 - RNA, 1755 nt, Artificial Sequence
  hemagglutinin__InfluenzaB__AFJ80150
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuucacgaagucagaccugucacauccggaugcuuuccuauaaugcacgacagaacaaaaaucagacagcuacccaaucuucucagaggauaugaaaaaaucagauuaucaacccagaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaacccacuaacaguagaaguaccauacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57276 - RNA, 1755 nt, Artificial Sequence
  hemagglutinin__InfluenzaB__AFJ80161
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacugucuggggguuccauucugauaacaaaacccaaaugaaaaaccucuauggagacucaaauccucaaaaguucaccucaucugcuaauggaauaaccacacauuauguuucucagauuggaggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauagguaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuucagagacaauguuucuugcuccaucugucuauaa

SEQ ID NO: 57277 - RNA, 1755 nt, Artificial Sequence
  hemagglutinin__InfluenzaB__AFJ80172
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuucacgaagucagaccugucacauccggaugcuuuccuauaaugcacgacagaacaaaaaucagacagcuacccaaucuucucagaggauaugaaaaaaucagauuaucaacccagaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaacccacuaacaguagaaguaccauacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcgacuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaaugggugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57278 - RNA, 1755 nt, Artificial Sequence
  hemagglutinin__InfluenzaB__AFJ80183
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugccucaacugcacagaucuggauguggccuuaggcaguccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacauagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucggcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcggucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57279 - RNA, 1755 nt, Artificial Sequence
  hemagglutinin__InfluenzaB__AFJ80194
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuucacgaagucagaccugucacauccggaugcuuuccuauaaugcacgacagaacaaaaaucagacagcuacccaaucuucucagaggauaugaaaaaaucagauuaucaacccagaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaacccacuaacaguagaaguaccauacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaagggucauugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuguuggcacuugagagaaaacuaaagaaaaugcugggucccucugcuguggacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57280 - RNA, 1755 nt, Artificial Sequence; identical to SEQ ID NO: 57266
  hemagglutinin__InfluenzaB__AFJ80205

SEQ ID NO: 57281 - RNA, 1755 nt, Artificial Sequence
  hemagglutinin__InfluenzaB__AFJ80216
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaaugcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57282 - RNA, 1755 nt, Artificial Sequence; identical to SEQ ID NO: 57266
  hemagglutinin__InfluenzaB__AFJ80227

SEQ ID NO: 57283 - RNA, 1758 nt, Artificial Sequence
  hemagglutinin__InfluenzaB__AFJ80238
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauaccuucagcaaaaguuucaauacuccaugaagucagaccuguuacaucugggugcuuuccuauaaugcacgacagaacaaaaauuagacagcugcccaaucuucucagaggauacgaacauaucagguuaucaauucauaacguuaucaaugcagaaaaggcaccaggaggacccuacaaaauuggaaccucagggucuugcccuaacguuaccaauggaaacggauucuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugucucgacagaauagcugcuggcaccuuugaugcaggagaauuuucucuccccacuuuugauucacugaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuugcuccaucugucuauaa

SEQ ID NO: 57284 - RNA, 1755 nt, Artificial Sequence
  hemagglutinin__InfluenzaB__AFJ80656
augaaggcaauaauuguacuacucaugguaguaacauccaaugcagaucgaaucugcacugggauaacaucgucaaacucaccucauguggucagaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggcauugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacaaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuaugucucucagauuggcggcuucccggaucaaacagaagacggagggcuaccacaaagcggcagaauuguuguugauuacauggugcaaaaaccuggaaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugaacuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagccauuuuuauuguuuauaugaucuccagagacaauguuucuugcuccaucugucuauaa

SEQ ID NO: 57285 - RNA, 1755 nt, Artificial Sequence; identical to SEQ ID NO: 57266
  hemagglutinin__InfluenzaB__AFJ80667

SEQ ID NO: 57286 - RNA, 1755 nt, Artificial Sequence
  hemagglutinin__InfluenzaB__AFJ80678
augaaggcaauaauuguacuacucaugguaguaacauccaaugcagaucgaaucugcacugggauaacaucgucaaacucaccucauguggucaaaacagcuacucaaggggaggucaaugugacuggugugauaccacuaacaacaacaccaacaaaaucucauuuugcaaaucucaaaggaacaaagaccagagggaaacuaugcccaaccugucucaacugcacagaucuggauguggccuuaggcagcccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacauagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaggaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggacgaucucagagcugacacaauaagcucacaaauagaacuugcggucuugcuuuccaacgaaggaauaauaaacagugaagaugagcaucuauuggcacuugagagaaaacuaaagaaaaugcugggucccucugcuguagacauagggaauggaugcuuugaaaccaaacacaaaugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57287 - RNA, 1755 nt, Artificial Sequence
  hemagglutinin__InfluenzaB__AFJ80689
augaaggcaauaauuguacuacucaugguaguaacauccaaugcagaucgaaucugcacugggauaacaucgucaaacucaccucauguggucaaaacagccacucaaggggaggucaaugugacugguguuauaccacugacaacaacaccaacaaaaucccauuuugcaaaucucaaaggaacaaagaccagagggaaacuaugcccaaccugucucaacugcacagaucuggauguggccuuaggcaguccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacauagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggggcuauugcugguuucuuagaaggaggaugggaaggaaugauugcagguuggcacggauacacaucucauggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugauacaauaagcucacaaauagaacuugcggucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 57288 - RNA, 1755 nt, Artificial Sequence
  hemagglutinin__InfluenzaB__AFJ80711
augaaggcaauaauuguacuacucaugguaguaacauccaaugcagaucgaaucugcacugggauaacaucuucaaacucaccucauguagucaaaacagccacucaaggggaggucaaugugacuggugugauaccacugacaacaacaccaauaaaaucuuauuuugcaaaucucaaaggaacaaagaccagagggaaacugugcccagacugucucaacuguacagaucuggauguggccuugggcagaccaauguguguggggaccacgccuucggcaaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacauggugcaaaaaccugggaaaacaggaacaauugucuaucaaagagguguuuuguugccucaaaagguauggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauauacaucucacggagcacauggaguggcaguggcggcagaccuuaagaguacgcaagaagcuauaaacaagauaacaaaaaaucucaauucuuugagugaacuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcugguaccuuuaaugcaggagaauuuucucuccccacuuuugauucacugaacauuacugcugcaucuuuaaaugaugauggauuggauaaccauaccauacugcucuauuacucaacugcugcuucuaguuuggcuguaacauugaugcuagcuauuuuuauuguuuauauggucuccagagacaacguuucaugcuccaucugucuauaa

SEQ ID NO: 57289 - RNA, 1755 nt, Artificial Sequence; identical to SEQ ID NO: 57288
  hemagglutinin__InfluenzaB__AFJ80722

SEQ ID NO: 57290 - RNA, 1755 nt, Artificial Sequence
  hemagglutinin__InfluenzaB__AFJ80733
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguauggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccugacgcuaccaauaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaggaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacagaauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57291 - RNA, 1758 nt, Artificial Sequence
  hemagglutinin__InfluenzaB__AFJ80744
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguucugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57292 - RNA, 1758 nt, Artificial Sequence; identical to SEQ ID NO: 57045
  hemagglutinin__InfluenzaB__AFJ80755

SEQ ID NO: 57293 - RNA, 1758 nt, Artificial Sequence
  hemagglutinin__InfluenzaB__AFJ80781
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucaggaucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuuaagugagcuggaaguaaagaaucuucaaagacuaagcggugccauggacgaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuuccugcuccaucugucuauaa

SEQ ID NO: 57294 - RNA, 1758 nt, Artificial Sequence
  hemagglutinin__InfluenzaB__AFJ80792
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguauggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguagcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57295 - RNA, 1758 nt, Artificial Sequence; identical to SEQ ID NO: 57045
  hemagglutinin__InfluenzaB__AFJ80803

SEQ ID NO: 57296 - RNA, 1758 nt, Artificial Sequence; identical to SEQ ID NO: 57045
  hemagglutinin__InfluenzaB__AFJ80814

SEQ ID NO: 57297 - RNA, 1758 nt, Artificial Sequence
  hemagglutinin__InfluenzaB__AFJ80825
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuauuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57298 - RNA, 1758 nt, Artificial Sequence
  hemagglutinin__InfluenzaB__AFJ80836
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucuucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57299 - RNA, 1758 nt, Artificial Sequence
  hemagglutinin__InfluenzaB__AFJ80847
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuccucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgaagcccaaauggcaaagcucuauggggacucaaaaccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57300 - RNA, 1758 nt, Artificial Sequence
  hemagglutinin__InfluenzaB__AFJ80858
augaaggcaauaauuguacuacucaugguaguaacauccaaugcagaucgaaucugcacugggauaacaucaucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggagacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacgauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccuacuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57301 - RNA, 1758 nt, Artificial Sequence
  hemagglutinin__InfluenzaB__AFJ80869
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaaucaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57302 - RNA, 1758 nt, Artificial Sequence
  hemagglutinin__InfluenzaB__AFJ80880
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacacaucagguuaucaacucauaacguuaucaaugcagaaaaugcaccaggaggacccuacaaaauuggaacuucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57303 - RNA, 1758 nt, Artificial Sequence; identical to SEQ ID NO: 57268
  hemagglutinin__InfluenzaB__AFJ80891

SEQ ID NO: 57304 - RNA, 1758 nt, Artificial Sequence
  hemagglutinin__InfluenzaB__AFJ80902
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaauguacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57305 - RNA, 1758 nt, Artificial Sequence
  hemagglutinin__InfluenzaB__AFJ80913
augaaggcaauaauuguacuacucaugguaguaacauccaaugcagauagaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57306 - RNA, 1758 nt, Artificial Sequence
  hemagglutinin__InfluenzaB__AFJ80924
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuugugcagaaggagaagaccaaauuaccguuuggggguuccacucugauaacgaaacccaaauggcaaagcucuauggggacucaaagccccagaaauucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccuacuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57307 - RNA, 1758 nt, Artificial Sequence; identical to SEQ ID NO: 57304
  hemagglutinin__InfluenzaB__AFJ80935

SEQ ID NO: 57308 - RNA, 1755 nt, Artificial Sequence; identical to SEQ ID NO: 57269
  hemagglutinin__InfluenzaB__AFJ80946

SEQ ID NO: 57309 - RNA, 1758 nt, Artificial Sequence
  hemagglutinin__InfluenzaB__AFJ80957
augaaggcaauaauuguacuacucaugguagcaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaauggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacagagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggagcaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuuaaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57310 - RNA, 1755 nt, Artificial Sequence
  hemagglutinin__InfluenzaB__AFJ80968
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57311 - RNA, 1755 nt, Artificial Sequence; identical to SEQ ID NO: 57310
  hemagglutinin__InfluenzaB__AFJ80979

SEQ ID NO: 57312 - RNA, 1755 nt, Artificial Sequence
  hemagglutinin__InfluenzaB__AFJ80990
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcggaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaauaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57313 - RNA, 1755 nt, Artificial Sequence; identical to SEQ ID NO: 57310
  hemagglutinin__InfluenzaB__AFJ81001

SEQ ID NO: 57314 - RNA, 1755 nt, Artificial Sequence
  hemagglutinin__InfluenzaB__AFJ84360
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggagaagaccaaauuacuguuuggggguuccauucagauaacaaaacccagaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57315 - RNA, 1758 nt, Artificial Sequence
  hemagglutinin__InfluenzaB__AFJ90395
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaauucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcuaggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauauugcuuuacuacucaacugcugccuccaguuuggcuguaacauugaugauagcuaucuuuguuguuuauauggucuccagagacaauguuucuugcuccaucugucuauaa

SEQ ID NO: 57316 - RNA, 1755 nt, Artificial Sequence
  hemagglutinin__InfluenzaB__AFJ90406
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuacuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57317 - RNA, 1755 nt, Artificial Sequence; identical to SEQ ID NO: 57316
  hemagglutinin__InfluenzaB__AFJ90417

SEQ ID NO: 57318 - RNA, 1755 nt, Artificial Sequence; identical to SEQ ID NO: 57310
  hemagglutinin__InfluenzaB__AFJ90428

SEQ ID NO: 57319 - RNA, 1755 nt, Artificial Sequence
  hemagglutinin__InfluenzaB__AFJ90450
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcugguaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57320 - RNA, 1755 nt, Artificial Sequence
  hemagglutinin__InfluenzaB__AFJ91038
augaaggcaauaauuguacuacucaugguaguaacauccaaugcggaucgaaucugcacugggauaacaucuucaaacucaccucauguggucaaaacagcuacucaaggggaggucaaugugaccggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57321 - RNA, 1755 nt, Artificial Sequence
  hemagglutinin__InfluenzaB__AFJ91049
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaauaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuacuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacuacucuauuacucaacugcugcuucuaguuuggcuguaacauugaugcuagcuauuuuuauuguuuauauggucuccagagacaacguuucaugcuccaucugucuauaa

SEQ ID NO: 57322 - RNA, 1758 nt, Artificial Sequence
  hemagglutinin__InfluenzaB__AFJ91060
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaagaugccucaacugcacagaucuggauguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggauuccacucugauaacgaggcccaaauggcaaagcucuauggggacucaaagccccagaaguucaccucaucugccaacggagugaccacacauuacguuucgcagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacaugggguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucuugacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcugugacauugaugauagcuaucuuuguuguuuauauggucuccagagacaauguuucuugcuccaucugucuauaa

SEQ ID NO: 57323 - RNA, 1755 nt, Artificial Sequence; identical to SEQ ID NO: 57273
  hemagglutinin__InfluenzaB__AFJ91071

SEQ ID NO: 57324 - RNA, 1755 nt, Artificial Sequence
  hemagglutinin__InfluenzaB__AFJ91082
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57325 - RNA, 1755 nt, Artificial Sequence; identical to SEQ ID NO: 57324
  hemagglutinin__InfluenzaB__AFJ91093

SEQ ID NO: 57326 - RNA, 1755 nt, Artificial Sequence; identical to SEQ ID NO: 57324
  hemagglutinin__InfluenzaB__AFJ91104

SEQ ID NO: 57327 - RNA, 1755 nt, Artificial Sequence; identical to SEQ ID NO: 57324
  hemagglutinin__InfluenzaB__AFJ91115

SEQ ID NO: 57328 - RNA, 1758 nt, Artificial Sequence
  hemagglutinin__InfluenzaB__AFJ91704
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaaaggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57329 - RNA, 1755 nt, Artificial Sequence
  hemagglutinin__InfluenzaB__AFK09797
augaaggcaauaauuguacuacucaugguaguaacauccaaugcagaucgaaucugcacugggauaacaucuucaaacucaccucauguagucaaaacagccacucaaggggaggucaaugugacuggugugauaccacugacaacaacaccaauaaaaucuuauuuugcaaaucucaaaggaacaaagaccagagggaaacugugcccagacugucucaacuguacagaucuggauguggccuugggcagaccaauguguguggggaccacgccuucggcaaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaaaccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacauggugcaaaaaccugggaaaacaggaacaauugucuaucaaagagguguuuuguugccucaaaagguauggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauauacaucucacggagcacauggaguggcaguggcggcagaccuuaagaguacgcaagaagcuauaaacaagauaacaaaaaaucucaauucuuugagugaacuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcugguaccuuuaaugcaggagaauuuucucuccccacuuuugauucacugaacauuacugcugcaucuuuaaaugaugauggauuggauaaccauaccauacugcucuauuacucaacugcugcuucuaguuuggcuguaacauugaugcuagcuauuuuuauuguuuauauggucuccagagacaacguuucaugcuccaucugucuauaa

SEQ ID NO: 57330 - RNA, 1755 nt, Artificial Sequence
  hemagglutinin__InfluenzaB__AFN54654
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57331 - RNA, 1755 nt, Artificial Sequence
  hemagglutinin__InfluenzaB__AFN54665
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggggacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57332 - RNA, 1755 nt, Artificial Sequence
  hemagglutinin__InfluenzaB__AFN54676
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57333 - RNA, 1755 nt, Artificial Sequence; identical to SEQ ID NO: 57330
  hemagglutinin__InfluenzaB__AFN54687

SEQ ID NO: 57334 - RNA, 1755 nt, Artificial Sequence
  hemagglutinin__InfluenzaB__AFN54698
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucauuugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaaccaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57335 - RNA, 1755 nt, Artificial Sequence; identical to SEQ ID NO: 57330
  hemagglutinin__InfluenzaB__AFN54709

SEQ ID NO: 57336 - RNA, 1755 nt, Artificial Sequence; identical to SEQ ID NO: 57330
  hemagglutinin__InfluenzaB__AFN54720

SEQ ID NO: 57337 - RNA, 1755 nt, Artificial Sequence; identical to SEQ ID NO: 57330
  hemagglutinin__InfluenzaB__AFN54731

SEQ ID NO: 57338 - RNA, 1755 nt, Artificial Sequence; identical to SEQ ID NO: 57330
  hemagglutinin__InfluenzaB__AFN54742

SEQ ID NO: 57339 - RNA, 1755 nt, Artificial Sequence; identical to SEQ ID NO: 57330
  hemagglutinin__InfluenzaB__AFN54753

SEQ ID NO: 57340 - RNA, 1755 nt, Artificial Sequence; identical to SEQ ID NO: 57330
  hemagglutinin__InfluenzaB__AFN54764

SEQ ID NO: 57341 - RNA, 1755 nt, Artificial Sequence
  hemagglutinin__InfluenzaB__AFN54775
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaagaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57342 - RNA, 1755 nt, Artificial Sequence; identical to SEQ ID NO: 57330
  hemagglutinin__InfluenzaB__AFN54786

SEQ ID NO: 57343 - RNA, 1755 nt, Artificial Sequence; identical to SEQ ID NO: 57330
  hemagglutinin__InfluenzaB__AFN54797

SEQ ID NO: 57344 - RNA, 1755 nt, Artificial Sequence; identical to SEQ ID NO: 57330
  hemagglutinin__InfluenzaB__AFN54808

SEQ ID NO: 57345 - RNA, 1755 nt, Artificial Sequence
  hemagglutinin__InfluenzaB__AFN54819
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugccccaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaacgcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57346 - RNA, 1755 nt, Artificial Sequence; identical to SEQ ID NO: 57330
  hemagglutinin__InfluenzaB__AFN54830

SEQ ID NO: 57347 - RNA, 1755 nt, Artificial Sequence
  hemagglutinin__InfluenzaB__AFN54841
augaaggcaauaauuguacuacucaugguaguaacauccaaugcagaucgaaucugcacugggauaacaucuucaaacucaccucauguggucaaaacagcuacucaaggggaggucaaugugacgggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugccaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57348 - RNA, 1755 nt, Artificial Sequence; identical to SEQ ID NO: 57330
  hemagglutinin__InfluenzaB__AFN54852

SEQ ID NO: 57349 - RNA, 1755 nt, Artificial Sequence; identical to SEQ ID NO: 57330
  hemagglutinin__InfluenzaB__AFN54863

SEQ ID NO: 57350 - RNA, 1758 nt, Artificial Sequence
  hemagglutinin__InfluenzaB__AFU34595
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauagggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuacugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccuacaaaacuauuaaaggaaagggguuucuucggagcuauugcugguuucuuagaaggaggaugggagggaaugauugcagguuggcacggauacacgucccauggggcccauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaagggauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57351 - RNA, 1758 nt, Artificial Sequence
  hemagglutinin__InfluenzaB__AFU34606
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaagggaacagaaaccagagggaaacuaugcccaaaaugccccaacugcacagaucuggacguagccuuggacagaccaaaaugcacggggaaaauacccucggcaagaguuucaauacuccaugaagucagacuuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugaugacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57352 - RNA, 1758 nt, Artificial Sequence
  hemagglutinin__InfluenzaB__AFU34617
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaagggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugaugacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57353 - RNA, 1758 nt, Artificial Sequence
  hemagglutinin__InfluenzaB__AFU34628
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaagggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugaugacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuuccucggagcuauugcugguuucuuagaaggaggauggaaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57354 - RNA, 1758 nt, Artificial Sequence
  hemagglutinin__InfluenzaB__AFU34639
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcauccuuaaaugacgauggauuggauaaucauaccauacugcuuuacuacucaacugcugccuccaguuuggcuguaacacugaugauagcuaucuucguuguuuauauggucuccagagacaauguuucuugcuccaucugucuauaa

SEQ ID NO: 57355 - RNA, 1758 nt, Artificial Sequence; identical to SEQ ID NO: 57189
  hemagglutinin__InfluenzaB__AGB08299

SEQ ID NO: 57356 - RNA, 1758 nt, Artificial Sequence; identical to SEQ ID NO: 57189
  hemagglutinin__InfluenzaB__AGB08300

SEQ ID NO: 57357 - RNA, 1755 nt, Artificial Sequence
  hemagglutinin__InfluenzaB__AGB97259
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguggaaguaccauacauuuguacagaaggggaagaccaaauuacuguuuggggguuccauucagauaacaaaacccaaaugaagagccucuacggagacucaaauccucaaaaguucaccucaucugcuaauggaguaaccacacauuauguuucucagauuggcgacuucccagaucaaacagaagacggaggacuaccacaaaguggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaagaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucccuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauagucuccagagacaacguuucaugcuccaucugucuauaa

SEQ ID NO: 57358 - RNA, 1755 nt, Artificial Sequence
  hemagglutinin__InfluenzaB__AGB97265
augaaggcaauaauuguacuacucaugguaguaacauccaaugcagaucgaaucugcacugggauaacaucuucaaacucaccucauguggucaaaacagcuacucaaggggaagucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucaugaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57359 - RNA, 1755 nt, Artificial Sequence
  hemagglutinin__InfluenzaB__AGF44878
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57360 - RNA, 1755 nt, Artificial Sequence
  hemagglutinin__InfluenzaB__AGF44879
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucggauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57361 - RNA, 1755 nt, Artificial Sequence
  hemagglutinin__InfluenzaB__AGF44881
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauaccauacugcucuauuacucaacugcugcuucuaguuuggcuguaauauugaugcuagcuauuuuuauuguuuauauggucuccagagacaacguuucaugcuccaucugucuauaa

SEQ ID NO: 57362 - RNA, 1755 nt, Artificial Sequence
  hemagglutinin__InfluenzaB__AGF44882
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggguaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaagagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcggguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57363 - RNA, 1755 nt, Artificial Sequence
  hemagglutinin__InfluenzaB__AGF44883
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57364 - RNA, 1755 nt, Artificial Sequence; identical to SEQ ID NO: 57359
  hemagglutinin__InfluenzaB__AGF44884

SEQ ID NO: 57365 - RNA, 1755 nt, Artificial Sequence; identical to SEQ ID NO: 57360
  hemagglutinin__InfluenzaB__AGF44886

SEQ ID NO: 57366 - RNA, 1755 nt, Artificial Sequence; identical to SEQ ID NO: 57363
  hemagglutinin__InfluenzaB__AGF44887

SEQ ID NO: 57367 - RNA, 1755 nt, Artificial Sequence; identical to SEQ ID NO: 57360
  hemagglutinin__InfluenzaB__AGF44888

SEQ ID NO: 57368 - RNA, 1755 nt, Artificial Sequence
  hemagglutinin__InfluenzaB__AGL09834
augaaggcaauaauuguacuacucaugguaguaacauccaaugcagaucgaaucugcacugggauaacaucuucaaacucaccucauguggucaaaacagcuacucaaggggaggucaaugugacugguguaauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagauuuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauga

SEQ ID NO: 57369 - RNA, 1755 nt, Artificial Sequence; identical to SEQ ID NO: 57359
  hemagglutinin__InfluenzaB__AGL09835

SEQ ID NO: 57370 - RNA, 1755 nt, Artificial Sequence
  hemagglutinin__InfluenzaB__AGL09836
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcaaaaaaagcaccaggaggacccuacagacuuggaaccucaggaucuugcccuaacgcuaccaguaaaagcggauuuuucgcaacaauggcuugggcugucccagaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57371 - RNA, 1755 nt, Artificial Sequence; identical to SEQ ID NO: 57359
  hemagglutinin__InfluenzaB__AGL09837

SEQ ID NO: 57372 - RNA, 1755 nt, Artificial Sequence; identical to SEQ ID NO: 57359
  hemagglutinin__InfluenzaB__AGL09838

SEQ ID NO: 57373 - RNA, 1755 nt, Artificial Sequence
  hemagglutinin__InfluenzaB__AGL09839
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcuaggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57374 - RNA, 1755 nt, Artificial Sequence; identical to SEQ ID NO: 57363
  hemagglutinin__InfluenzaB__AGL09840

SEQ ID NO: 57375 - RNA, 1755 nt, Artificial Sequence; identical to SEQ ID NO: 57363
  hemagglutinin__InfluenzaB__AGL09841

SEQ ID NO: 57376 - RNA, 1758 nt, Artificial Sequence
  hemagglutinin__InfluenzaB__AGL09842
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuuaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagaaacaaauccauuaacaauagaaguaccauacauuuguacagaaggagaagaccaaauuaccguuuggggguuccacucugacaacgagacccaaauggcaaagcucuauggggacucaaaaccccagaaguucaccucaucugccaacggagugaccacacauuauguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57377 - RNA, 1755 nt, Artificial Sequence
  hemagglutinin__InfluenzaB__AGL09843
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuugggaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaagcuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57378 - RNA, 1755 nt, Artificial Sequence
  hemagglutinin__InfluenzaB__AGL09844
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaaaagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuuuuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57379 - RNA, 1755 nt, Artificial Sequence; identical to SEQ ID NO: 57363
  hemagglutinin__InfluenzaB__AGL09845

SEQ ID NO: 57380 - RNA, 1755 nt, Artificial Sequence
  hemagglutinin__InfluenzaB__AGL09846
augaaggcaauaauuguacuacucaugguaguaacauccaaugcagaucgaaucugcacugggauaacaucuucaaacucaccucauguggucaaaacagcuacucaaggggagguuaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccaucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuugggaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauaggccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacgcaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaagcuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57381 - RNA, 1755 nt, Artificial Sequence
  hemagglutinin__InfluenzaB__AGL09847
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuauuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauaccauacugcucuauuacucaacugcugcuucuaguuuggcuguaacauugaugcuagcuauuuuuauuguuuauauggucuccagagacaacguuucaugcuccaucugucuauaa

SEQ ID NO: 57382 - RNA, 1755 nt, Artificial Sequence
  hemagglutinin__InfluenzaB__AGL09849
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucaaugcagaaaaagcaccaggaggacccuacagacuuggaaccucaggaucuugcccuaacgcuaccaguaaaagcggauuuuuugcaacaauggcuugggcugucccaaaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57383 - RNA, 1755 nt, Artificial Sequence
  hemagglutinin__InfluenzaB__AGL09850
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacacccuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57384 - RNA, 1755 nt, Artificial Sequence
  hemagglutinin__InfluenzaB__AGL09851
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 57385 - RNA, 1758 nt, Artificial Sequence
  hemagglutinin__InfluenzaB__AGL09852
augaaggcaauaauuguacuacucaugguaguaacauccaaugcagaucgaaucugcacugggauaacaucgucaaacucaccacaugucgucaaaacugcuacucaaggggaagucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacgaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucucccaaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57386 - RNA, 1755 nt, Artificial Sequence
  hemagglutinin__InfluenzaB__AGL09853
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcagaccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuugggaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57387 - RNA, 1755 nt, Artificial Sequence; identical to SEQ ID NO: 57363
  hemagglutinin__InfluenzaB__AGL09854

SEQ ID NO: 57388 - RNA, 1758 nt, Artificial Sequence
  hemagglutinin__InfluenzaB__AGL09855
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuuaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagaaacaaauccauuaacaauagaaguaccauacauuuguacagaagaagaagaccaaauuaccguuuggggguuccacucugacaacgagacccaaauggcaaagcucuauggggacucaaagccccagaaguucaccucaucugccaacggagugaccacacauuacguuucacagauuggugacuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggcuauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuucuaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57389 - RNA, 1755 nt, Artificial Sequence
  hemagglutinin__InfluenzaB__AGL09856
augaaggcaauaauuguacuacucaugguaguaacauccaaugcagaucgaaucugcacuggaauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggguaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguucuguugccucaaaagguguggugcgcgagugguaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57390 - RNA, 1755 nt, Artificial Sequence
  hemagglutinin__InfluenzaB__AGL09857
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaaaguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggaagaauugucguugauuacaugauacaaaaaccugggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguugcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57391 - RNA, 1758 nt, Artificial Sequence
  hemagglutinin__InfluenzaB__AGL09859
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57392 - RNA, 1758 nt, Artificial Sequence
  hemagglutinin__InfluenzaB__AGL09860
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagauuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57393 - RNA, 1758 nt, Artificial Sequence; identical to SEQ ID NO: 57391
  hemagglutinin__InfluenzaB__AGL09861

SEQ ID NO: 57394 - RNA, 1758 nt, Artificial Sequence; identical to SEQ ID NO: 57391
  hemagglutinin__InfluenzaB__AGL09862

SEQ ID NO: 57395 - RNA, 1758 nt, Artificial Sequence; identical to SEQ ID NO: 57391
  hemagglutinin__InfluenzaB__AGL09863

SEQ ID NO: 57396 - RNA, 1755 nt, Artificial Sequence
  hemagglutinin__InfluenzaB__AGL09864
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcagcuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 57397 - RNA, 1755 nt, Artificial Sequence; identical to SEQ ID NO: 57359
  hemagglutinin__InfluenzaB__AGL09866

SEQ ID NO: 57398 - RNA, 1755 nt, Artificial Sequence; identical to SEQ ID NO: 57360
  hemagglutinin__InfluenzaB__AGL09867

SEQ ID NO: 57399 - RNA, 1755 nt, Artificial Sequence
  hemagglutinin__InfluenzaB__AGL09868
augaaggcaauaauuguacuacucaugguaguaacauccaaugcagaucgaaucugcacugggauaacaucuucaaacucaccucauguagucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57400 - RNA, 1755 nt, Artificial Sequence
  hemagglutinin__InfluenzaB__AGL09869
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacacuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucggauaacaaaacccaaaugaagaaccucuauggagacucaaauccucaaaaguucaccucaucugcuaauggaguaaccacacacuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuuuggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57401 - RNA, 1755 nt, Artificial Sequence
  hemagglutinin__InfluenzaB__AGL09870
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaagguucaccucaucugcuaauggaguaaccacacauuauguuucucagauuggcggcuucccagaucaaacagaagacggaggacuaccacaaagcggaagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguugcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuagucuggcuguaacauugaugcuagcuauuuuuauuguuuauauggucuccagagacaacguuucaugcuccaucugucuauaa

SEQ ID NO: 57402 - RNA, 1755 nt, Artificial Sequence
  hemagglutinin__InfluenzaB__AGL09871
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucgcacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57403 - RNA, 1755 nt, Artificial Sequence
  hemagglutinin__InfluenzaB__AGL09872
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacacccucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuaucuuuauuguuuauauggucuccagagacaacguuucaugcuccaucugucuauga

SEQ ID NO: 57404 - RNA, 1755 nt, Artificial Sequence; identical to SEQ ID NO: 57360
  hemagglutinin__InfluenzaB__AGL09873

SEQ ID NO: 57405 - RNA, 1758 nt, Artificial Sequence; identical to SEQ ID NO: 57391
  hemagglutinin__InfluenzaB__AGL09874

SEQ ID NO: 57406 - RNA, 1758 nt, Artificial Sequence
  hemagglutinin__InfluenzaB__AGO02695
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuuaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagaaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuccaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57407 - RNA, 1755 nt, Artificial Sequence
  hemagglutinin__InfluenzaB__AGQ16249
augaaggcaauaauuguacuacucaugguaguaacauccaaugcagaucgaaucugcacuggaauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggguaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgagugguaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57408 - RNA, 1758 nt, Artificial Sequence
  hemagglutinin__InfluenzaB__AGQ16250
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguugucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugaugauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57409 - RNA, 1758 nt, Artificial Sequence; identical to SEQ ID NO: 57391
  hemagglutinin__InfluenzaB__AGQ16251

SEQ ID NO: 57410 - RNA, 1755 nt, Artificial Sequence
  hemagglutinin__InfluenzaB__AGQ16252
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccagcaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuccucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguaaagaaggggaagaccaaauuacuguuuggggguuccauucagauaacaaaacccaaaugaagaaccucuauggagacucaaauccucaaaaguucaccucaucugcuaauggaguaacuacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaggaauacgguggauuaaacaaaagcaagccuuacuacacaggaaaacaugcaaaagccauaggaaacugcccaauauggguaaaaacaccuuugaagcuugccaaugggaccaaauauagaccuccugcaaaacuauuaaaggaaagggguuucuucggggcuauugcugguuuccuagaaggaggaugggaaggaaugauugcagguuggcacggauacacaucucacggagcacauggaguggcaguggcggcagaccuuaagaguacacaagaagcuauaaauaaaauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57411 - RNA, 1755 nt, Artificial Sequence
  hemagglutinin__InfluenzaB__AGQ16253
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucauggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 57412 - RNA, 1755 nt, Artificial Sequence
  hemagglutinin__InfluenzaB__AGQ16255
augaaggcaauaauuguacuacucaugguaguaacauccaaugcagaucgaaucugcacuggaauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggguaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaauaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgagugguaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauauuauacugcucuauuacucaacugcugcuucuaguuuggcuguaacauugaugcuagcuauuuuuauuguuuauauggucuccagagacaacguuucaugcuccaucugucuauaa

SEQ ID NO: 57413 - RNA, 1755 nt, Artificial Sequence
  hemagglutinin__InfluenzaB__AGQ16256
augaaggcaauaauuguacuacucaugguaguaacauccaaugcagaucgaaucugcacugggauaacaucuucaaacucaccucauguggucaaaacaguuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaagacagcaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuauugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcaguaacauugaugcuagcuauuuuuauuguuuauauggucuccagagacaacguuucaugcuccaucugucuauaa

SEQ ID NO: 57414 - RNA, 1755 nt, Artificial Sequence
  hemagglutinin__InfluenzaB__AGQ16257
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucauugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 57415 - RNA, 1755 nt, Artificial Sequence
  hemagglutinin__InfluenzaB__AGQ16258
augaaggcaauaauuguacuacuaaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggcccugggcaggccaaugugugugggaacuacaccuucugcgaaagcuucaauacuucacgaagucagaccugucacauccgggugcuucccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauaugguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaaugaaauacucgagcuggaugagaaaguggaugaccucagagcugacacuauaaguucacaaauagaacuugcugucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57416 - RNA, 1755 nt, Artificial Sequence
  hemagglutinin__InfluenzaB__AGQ16259
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucggauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57417 - RNA, 1755 nt, Artificial Sequence
  hemagglutinin__InfluenzaB__AGQ16260
augaagacaauaauuguacuacucaugguaguaacauccaaugcagauagaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaucccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcgguagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaggcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauaacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57418 - RNA, 1755 nt, Artificial Sequence; identical to SEQ ID NO: 57407
  hemagglutinin__InfluenzaB__AGQ16261

SEQ ID NO: 57419 - RNA, 1755 nt, Artificial Sequence
  hemagglutinin__InfluenzaB__AGQ16262
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaccaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 57420 - RNA, 1758 nt, Artificial Sequence
  hemagglutinin__InfluenzaB__AGQ16263
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguugucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaccucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57421 - RNA, 1758 nt, Artificial Sequence; identical to SEQ ID NO: 57391
  hemagglutinin__InfluenzaB__AGQ16264

SEQ ID NO: 57422 - RNA, 1755 nt, Artificial Sequence
  hemagglutinin__InfluenzaB__AGQ16265
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57423 - RNA, 1755 nt, Artificial Sequence
  hemagglutinin__InfluenzaB__AGQ16266
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccagcaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagguuggcggcuucccagaucaaacagaagacggaggacuaccacaaagcggcagaauuguuguugauuacaugaugcaaaaaccugggaaaacaggaacaauugucuaucaaagagguguuuuauugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcaguaacauugaugcuagcuauuuuuauuguuuauauggucuccagagacaacguuucaugcuccaucugucuauaa

SEQ ID NO: 57424 - RNA, 1755 nt, Artificial Sequence; identical to SEQ ID NO: 57422
  hemagglutinin__InfluenzaB__AGQ16267

SEQ ID NO: 57425 - RNA, 1755 nt, Artificial Sequence
  hemagglutinin__InfluenzaB__AGQ16268
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57426 - RNA, 1758 nt, Artificial Sequence
  hemagglutinin__InfluenzaB__AGQ16269
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuuaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagaaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuggaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57427 - RNA, 1755 nt, Artificial Sequence
  hemagglutinin__InfluenzaB__AGQ16270
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacaaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauaccauacugcucuauuacucaacugcugcuucuaguuuggcuguaacauugaugcuagcuauuuuuauuguuuauauggucuccagagacaacguuucaugcuccaucugucuauaa

SEQ ID NO: 57428 - RNA, 1755 nt, Artificial Sequence
  hemagglutinin__InfluenzaB__AGQ16272
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaagggacaacaacaaaaaugcaacgaacccauuaacaguagaaguaccauacauuugugaagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcaguccugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 57429 - RNA, 1755 nt, Artificial Sequence
  hemagglutinin__InfluenzaB__AGQ16273
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaaguuagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57430 - RNA, 1755 nt, Artificial Sequence
  hemagglutinin__InfluenzaB__AGQ16274
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcauggauacacaucucacggagcacauggaguggcaguugcugcagaccuuaagagcacacaagaagcuauaaacaagauaacaaaaaaucucaacucuuugagugagcuagaagugaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57431 - RNA, 1755 nt, Artificial Sequence
  hemagglutinin__InfluenzaB__AGQ16275
augaaggcaauaauuguacuacucaugguaguaacauccaaugcagaucgaaucugcacuggaauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcaugacagaacaaaaaucaggcaacuagccaaucuucucagaggguaugaaaauaucagguuaucaacccaaaacguuaucgaugcagaaaaagcaccaggaggacccuacagacuugggaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgagugguaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57432 - RNA, 1755 nt, Artificial Sequence
  hemagglutinin__InfluenzaB__AGQ16276
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacacccuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 57433 - RNA, 1755 nt, Artificial Sequence
  hemagglutinin__InfluenzaB__AGQ16277
augaaagcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucagggucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacuugagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57434 - RNA, 1755 nt, Artificial Sequence
  hemagglutinin__InfluenzaB__AGQ16278
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacuugagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57435 - RNA, 1755 nt, Artificial Sequence
  hemagglutinin__InfluenzaB__AGQ16279
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugaaaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57436 - RNA, 1755 nt, Artificial Sequence; identical to SEQ ID NO: 57422
  hemagglutinin__InfluenzaB__AGQ16280

SEQ ID NO: 57437 - RNA, 1755 nt, Artificial Sequence
  hemagglutinin__InfluenzaB__AGQ16281
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcagcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcuggcuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaagguggaugaucucagagcugacacuauaaguucacaaauagaacuugcagucuugcuuuccaacgaaggaauaauaaacagugaagaugagcaucuauuggcacuugagagaaaacuaaagaaaaugcuaggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57438 - RNA, 1755 nt, Artificial Sequence
  hemagglutinin__InfluenzaB__AGQ16282
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaagggcaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaagguucaccucaucugcuaauggaguaaccacacauuauguuucucagauuggcggcuucccagaucaaacagaagacggaggacuaccacaaagcggaagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguugcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuagucuggcuguaacauugaugcuagcuauuuuuauuguuuauauggucuccagagacaacguuucaugcuccaucugucuauaa

SEQ ID NO: 57439 - RNA, 1755 nt, Artificial Sequence
  hemagglutinin__InfluenzaB__AGQ16283
augaaggcaauaauuguacuacucaugguaguaacauccaaugcagaucgaaucugcacugggauaacaucuucaaacucaccucauguggucaaaacagcuacucacggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacaaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauaccauacugcucuauuacucaacugcugcuucuaguuuggcuguaacauugaugcuagcuauuuuuauuguuuauauggucuccagagacaacguuucaugcuccaucugucuauaa

SEQ ID NO: 57440 - RNA, 1758 nt, Artificial Sequence
  hemagglutinin__InfluenzaB__AGQ16284
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagacccaaaugcacggggaaaauacccucggcaagaguuucaauacuccaugaagccagaccuguuacaucugggugcuuuccuauaaugcacgauagaacaaaaauuagacagcugccuaaccuucuccgaggauacgaacauaucaaguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucuugacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57441 - RNA, 1755 nt, Artificial Sequence
  hemagglutinin__InfluenzaB__AGQ16285
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagaggaaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggauuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaaugggaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauaccauacugcucuauuacucaacugcugcuucuaguuuggcuguaacauugaugcuagcuauuuuuauuguuuauauggucuccagagacaacguuucaugcuccaucugucuauaa

SEQ ID NO: 57442 - RNA, 1755 nt, Artificial Sequence; identical to SEQ ID NO: 57425
  hemagglutinin__InfluenzaB__AGQ16286

SEQ ID NO: 57443 - RNA, 1755 nt, Artificial Sequence
  hemagglutinin__InfluenzaB__AGQ16287
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugaagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauaugguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57444 - RNA, 1755 nt, Artificial Sequence
  hemagglutinin__InfluenzaB__AGQ16289
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 57445 - RNA, 1755 nt, Artificial Sequence; identical to SEQ ID NO: 57429
  hemagglutinin__InfluenzaB__AGQ16290

SEQ ID NO: 57446 - RNA, 1755 nt, Artificial Sequence
  hemagglutinin__InfluenzaB__AGQ16291
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacacccucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacacuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggauguuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuaucuuuauuguuuauauggucuccagagacaacguuucaugcuccaucugucuauga

SEQ ID NO: 57447 - RNA, 1755 nt, Artificial Sequence
  hemagglutinin__InfluenzaB__AGQ16292
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaauaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57448 - RNA, 1755 nt, Artificial Sequence; identical to SEQ ID NO: 57447
  hemagglutinin__InfluenzaB__AGQ16293

SEQ ID NO: 57449 - RNA, 1755 nt, Artificial Sequence; identical to SEQ ID NO: 57447
  hemagglutinin__InfluenzaB__AGQ16294

SEQ ID NO: 57450 - RNA, 1758 nt, Artificial Sequence
  hemagglutinin__InfluenzaB__AGQ16295
augaaggcaauaauuguacuacucaugguaguaacauccaaugcagaucgaaucugcacugggauaacaucgucaaacucaccacaugucgucaaaacugcuacucaaggggaggucaaugugaccggugcaauaccacugacaacaacacccaccaaaucucauuuugcaaaucucaaaggaacagaaaccagggggaaacuaugcccaaaaugccuuaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagaaacaaauccauuaacaauagaaguaccauacauuuguacagaagaagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuucuaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57451 - RNA, 1758 nt, Artificial Sequence
  hemagglutinin__InfluenzaB__AGQ16296
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguugucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugaguuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57452 - RNA, 1755 nt, Artificial Sequence
  hemagglutinin__InfluenzaB__AGQ16297
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacgugucaugcuccaucugucuauaa

SEQ ID NO: 57453 - RNA, 1755 nt, Artificial Sequence
  hemagglutinin__InfluenzaB__AGQ16298
augaaggcaauaauuguacuacucaugguaguaacauccaaugcagaucgaaucugcacuggaauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggguaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgagugguaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaauugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57454 - RNA, 1755 nt, Artificial Sequence
  hemagglutinin__InfluenzaB__AGQ16299
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacaaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucucugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauaccauacugcucuauuacucaacugcugcuucuaguuuggcuguaacauugaugcuagcuauuuuuauuguuuauauggucuccagagacaacguuucaugcuccaucugucuauaa

SEQ ID NO: 57455 - RNA, 1755 nt, Artificial Sequence
  hemagglutinin__InfluenzaB__AGQ16300
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuauaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57456 - RNA, 1755 nt, Artificial Sequence
  hemagglutinin__InfluenzaB__AGQ16301
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57457 - RNA, 1755 nt, Artificial Sequence; identical to SEQ ID NO: 57411
  hemagglutinin__InfluenzaB__AGQ16302

SEQ ID NO: 57458 - RNA, 1755 nt, Artificial Sequence
  hemagglutinin__InfluenzaB__AGQ16303
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcagcuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuugaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 57459 - RNA, 1755 nt, Artificial Sequence
  hemagglutinin__InfluenzaB__AGQ16305
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagaggaaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugccaauggaguaaccacacauuauguuucucagauuggcggcuucccagaucaaacagaagacggagggcuaccacaaagcggcagaauugucguugauuacaugaugcaaaaaccugggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggguuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57460 - RNA, 1758 nt, Artificial Sequence
  hemagglutinin__InfluenzaB__AGQ16306
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuuaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacggaaacaaauccauuaacaauagaaguaccauacauuuguaaagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57461 - RNA, 1755 nt, Artificial Sequence; identical to SEQ ID NO: 57359
  hemagglutinin__InfluenzaB__AGQ16307

SEQ ID NO: 57462 - RNA, 1758 nt, Artificial Sequence
  hemagglutinin__InfluenzaB__AGQ16308
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccugugacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuauuacucaacugcugccuccaguuuggcuguaacacugaugauagcuaucuuuguuguuuauauggucuccagagacaauguuucuugcuccaucugucuauaa

SEQ ID NO: 57463 - RNA, 1755 nt, Artificial Sequence
  hemagglutinin__InfluenzaB__AGQ16309
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucgcugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57464 - RNA, 1755 nt, Artificial Sequence
  hemagglutinin__InfluenzaB__AGQ16310
augaaggcaauaauuguacuacucaugguaguaacauccaaugcagaucgaaucugcacuggaauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauugacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugguugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuuacuuuccaacgaaggaauaauaaacagugaagaugagcaucuguuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57465 - RNA, 1758 nt, Artificial Sequence
  hemagglutinin__InfluenzaB__AGQ16311
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcuccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57466 - RNA, 1755 nt, Artificial Sequence; identical to SEQ ID NO: 57429
  hemagglutinin__InfluenzaB__AGQ16312

SEQ ID NO: 57467 - RNA, 1755 nt, Artificial Sequence
  hemagglutinin__InfluenzaB__AGQ16313
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaaaggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57468 - RNA, 1758 nt, Artificial Sequence
  hemagglutinin__InfluenzaB__AGQ16314
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuuaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagaaacaaauccauuaacaauagaaguaccauacauuuguacagaagaagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuucuaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57469 - RNA, 1755 nt, Artificial Sequence
  hemagglutinin__InfluenzaB__AGQ16315
augaaggcaauaauuguacuacucaugguaguaacauccaaugcagaucgaaucugcacuggaauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggguaugaaaauaucagguuaucaacccaaaccguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaauaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgagugguaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauauuauacugcucuauuacucaacugcugcuucuaguuuggcuguaacauugaugcuagcuauuuuuauuguuuauauggucuccagagacaacguuucaugcuccaucugucuauaa

SEQ ID NO: 57470 - RNA, 1755 nt, Artificial Sequence
  hemagglutinin__InfluenzaB__AGQ16316
augaaggcaauaauuguacuacucaugguaguaacauccaaugcagauagaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgagauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57471 - RNA, 1755 nt, Artificial Sequence; identical to SEQ ID NO: 57407
  hemagglutinin__InfluenzaB__AGQ16317

SEQ ID NO: 57472 - RNA, 1758 nt, Artificial Sequence
  hemagglutinin__InfluenzaB__AGQ16318
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggcuacgaacauaucagguuaucaacucacaacguuaucaaugcagaaaaugcaccaggaggacccuacaaaauuggaaccucagggucuugcccuaauguuaccaauggaaacggauucuucgcaacaauggcuugggccgucccaaaaaacgacaaaaacaaaacagcaacaaauccauuaacaauagaagugccauacauuuguacagaaggagaagaccaaauuaccguuuggggguuccacucugacaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaaaugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57473 - RNA, 1755 nt, Artificial Sequence
  hemagglutinin__InfluenzaB__AGQ16319
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccaggcugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaaugcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57474 - RNA, 1755 nt, Artificial Sequence
  hemagglutinin__InfluenzaB__AGQ16320
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugccucuaguuuggcuguaacauugaugcuagcuauuuuuauuguuuauauggucuccagagacaacguuucaugcuccaucugccuauaa

SEQ ID NO: 57475 - RNA, 1755 nt, Artificial Sequence
  hemagglutinin__InfluenzaB__AGQ16321
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuuuggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57476 - RNA, 1755 nt, Artificial Sequence
  hemagglutinin__InfluenzaB__AGQ16322
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcuguuccaaaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuagcuguaacauugaugcuagcuauuuuuauuguuuauauggucuccagagacaacguuucaugcuccaucugucuauaa

SEQ ID NO: 57477 - RNA, 1758 nt, Artificial Sequence
  hemagglutinin__InfluenzaB__AGQ16323
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaagucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaagugaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57478 - RNA, 1755 nt, Artificial Sequence
  hemagglutinin__InfluenzaB__AGQ16324
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagagguaccauacauuugugcagaaggagaagaccaaauuacuguuuggggguuccauucagauaacaaaacccaaaugaagaaccucuauggagacucaaauccucaaaaguucaccucauccgcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57479 - RNA, 1755 nt, Artificial Sequence
  hemagglutinin__InfluenzaB__AGQ16325
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcagcuagccaaucuucucagaggauaugaaaauauuagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaaucacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 57480 - RNA, 1755 nt, Artificial Sequence
  hemagglutinin__InfluenzaB__AGQ16326
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaagaucaggcaacuagccaaucuucucagaggauaugaaaauaucagguuaucaacccaaaauguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 57481 - RNA, 1755 nt, Artificial Sequence; identical to SEQ ID NO: 57475
  hemagglutinin__InfluenzaB__AGQ16327

SEQ ID NO: 57482 - RNA, 1758 nt, Artificial Sequence
  hemagglutinin__InfluenzaB__AGQ16328
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaacacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaacggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaccucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaacauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57483 - RNA, 1758 nt, Artificial Sequence
  hemagglutinin__InfluenzaB__AGX15487
augaaggcaauaauuguacuacucaugguaguaacauccaaugcagaucgaaucugcacugggauaacaucgucaaacucaccccauguggucaaaacugccacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57484 - RNA, 1758 nt, Artificial Sequence
  hemagglutinin__InfluenzaB__AGX15496
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguggagauagggaauggaugcuucgaaaccaaacacaagugcaaccagaccugucucgacagaauagcugcugguaccuuugaugcaggagaauuuucucucccuacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57485 - RNA, 1758 nt, Artificial Sequence
  hemagglutinin__InfluenzaB__AGX15518
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacagcacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaccugggaaaacaggaacaauuaccuaucaaagagguauuuuauugccucaaaaaguguggugugcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcagugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugaugauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57486 - RNA, 1758 nt, Artificial Sequence
  hemagglutinin__InfluenzaB__AGX15529
augaaggcaauaauuguacuacucaugguaguaacauccaaugcagaucgagucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacucuaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggaaccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57487 - RNA, 1758 nt, Artificial Sequence
  hemagglutinin__InfluenzaB__AGX15541
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaagauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucacaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57488 - RNA, 1758 nt, Artificial Sequence
  hemagglutinin__InfluenzaB__AGX15552
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaagauuagacagcugccuaaccuucucagaggauacgaacauaucagguuaucaacucauaacguuaucaaugcaaaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57489 - RNA, 1758 nt, Artificial Sequence
  hemagglutinin__InfluenzaB__AGX15563
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauugacaauagaaguaccauacauuuguacagaaggagaagaccaaauuaccguuuggggguuccacucugauaacgaagcccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugagaccaaacacaaaugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57490 - RNA, 1758 nt, Artificial Sequence
  hemagglutinin__InfluenzaB__AGX15574
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcgaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaagauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaggcccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57491 - RNA, 1758 nt, Artificial Sequence
  hemagglutinin__InfluenzaB__AGX15607
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacacacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagagaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggaguaaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugugcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggggaauuuucucuccccaccuuugauucacuaaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57492 - RNA, 1758 nt, Artificial Sequence
  hemagglutinin__InfluenzaB__AGX15629
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcacaaguggcaggagcaagguaauaaaaggauccuugccuuuaauuggagaagcagauugccuccacgaaaaauacgguggauuaaacaaaagcaagcccuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57493 - RNA, 1758 nt, Artificial Sequence
  hemagglutinin__InfluenzaB__AGX15651
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57494 - RNA, 1758 nt, Artificial Sequence
  hemagglutinin__InfluenzaB__AGX15675
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggagggcuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57495 - RNA, 1758 nt, Artificial Sequence
  hemagglutinin__InfluenzaB__AGX15686
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57496 - RNA, 1758 nt, Artificial Sequence
  hemagglutinin__InfluenzaB__AGX15697
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugacaacgagaaccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57497 - RNA, 1758 nt, Artificial Sequence
  hemagglutinin__InfluenzaB__AGX15708
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucuggguguuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57498 - RNA, 1758 nt, Artificial Sequence
  hemagglutinin__InfluenzaB__AGX15719
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57499 - RNA, 1758 nt, Artificial Sequence
  hemagglutinin__InfluenzaB__AGX15730
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57500 - RNA, 1758 nt, Artificial Sequence
  hemagglutinin__InfluenzaB__AGX15741
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57501 - RNA, 1758 nt, Artificial Sequence
  hemagglutinin__InfluenzaB__AGX15753
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcaauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57502 - RNA, 1758 nt, Artificial Sequence
  hemagglutinin__InfluenzaB__AGX15764
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuauaacacugaugauagcuaucuuuguuguuuauauggucuccagagacaauguuucuugcuccaucugucuauaa

SEQ ID NO: 57503 - RNA, 1755 nt, Artificial Sequence
  hemagglutinin__InfluenzaB__AGX15775
augaaggcaauaauuguacuacucaugguaguaacauccaaugcagaucgaaucugcacuggaauaacauccucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaauccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaggguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57504 - RNA, 1758 nt, Artificial Sequence
  hemagglutinin__InfluenzaB__AGX15786
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuuuucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57505 - RNA, 1758 nt, Artificial Sequence; identical to SEQ ID NO: 57501
  hemagglutinin__InfluenzaB__AGX15797

SEQ ID NO: 57506 - RNA, 1758 nt, Artificial Sequence
  hemagglutinin__InfluenzaB__AGX15808
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaacaucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaauuggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57507 - RNA, 1758 nt, Artificial Sequence
  hemagglutinin__InfluenzaB__AGX15830
augaaggcaauaauuguacuacucaugguaguaacauccaaugcagaucgaaucugcacugggauaacaucgucaaacucaccacaugucgucaaaacugcuacucaaggggaagucaaugugacugguguaauaccacugacaacaacacccacgaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcuuuauggggacucaaagccccagaaguucaccucaucugccaacggagugaccacacauuacguuucacagauuggcggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuggaaggaggaugggaaggaaugauugcagguuggcacggauacacgucccauggggcacauggaguagcgguggcagcagaccuuaagagcacucaagaggccauaaacaagauaacaaaaaaucuuaacucuuugagugaacuggaaguaaagaaucuucaaagacuaagcggugccauggaugaacuccacaacgaaauacuagaacuagacgagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57508 - RNA, 1758 nt, Artificial Sequence; identical to SEQ ID NO: 57144
  hemagglutinin__InfluenzaB__AGX15841

SEQ ID NO: 57509 - RNA, 1758 nt, Artificial Sequence; identical to SEQ ID NO: 57112
  hemagglutinin__InfluenzaB__AGX15852

SEQ ID NO: 57510 - RNA, 1758 nt, Artificial Sequence
  hemagglutinin__InfluenzaB__AGX15863
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcaguggcagcagaccuuaagagcacucaagaggccauaaacaagauaacaaaaaaucucaacucuuugagugagcuggaaguaaagaaucuucaaagacuaaguggugccauggaugaacuccacaacgaaauacuggaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57511 - RNA, 1758 nt, Artificial Sequence
  hemagglutinin__InfluenzaB__AGX15874
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauugaauaaucauaccauacugcuuuacuacucaacugcugccuccaguuuggcuguaacacugaugauagccaucuuuguuguuuauauggucuccagagacaauguuucuugcuccaucugucuauaa

SEQ ID NO: 57512 - RNA, 1758 nt, Artificial Sequence
  hemagglutinin__InfluenzaB__AGX15885
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57513 - RNA, 1758 nt, Artificial Sequence
  hemagglutinin__InfluenzaB__AGX15896
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccgcacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacggcgaaauacuagaacuagacgagaaaguggaugaucucagagcugauacaauaagcucgcaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57514 - RNA, 1758 nt, Artificial Sequence
  hemagglutinin__InfluenzaB__AGX15907
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucuggaugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaagccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57515 - RNA, 1758 nt, Artificial Sequence
  hemagglutinin__InfluenzaB__AGX15918
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57516 - RNA, 1758 nt, Artificial Sequence
  hemagglutinin__InfluenzaB__AGX15929
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacuaauaacguuaucaaugcagaaaaugcaccaggaggacccuacaaaauuggaacaucagggucuugcccuaacguuaccaauggaaacggauucuucgcaacaauggccugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugagaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuccaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57517 - RNA, 1758 nt, Artificial Sequence
  hemagglutinin__InfluenzaB__AGX15940
augaaggcaauaauuguacuacuuaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57518 - RNA, 1758 nt, Artificial Sequence
  hemagglutinin__InfluenzaB__AGX15962
augaaggcaauaauuguacuacucaugguaguaacauccaaugcagaucgaaucugcacugggauaacaucgucaaacucaccacauaucgucaaaacugccacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugaugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57519 - RNA, 1758 nt, Artificial Sequence
  hemagglutinin__InfluenzaB__AGX15973
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuaaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcuauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57520 - RNA, 1758 nt, Artificial Sequence
  hemagglutinin__InfluenzaB__AGX15984
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuaaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcuauaggaaauugcccaauauggguaaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaccucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57521 - RNA, 1758 nt, Artificial Sequence
  hemagglutinin__InfluenzaB__AGX15995
augaaggcaauaauuguacuacucaugguaguaacauccaaugcagaucgaaucugcacugggauaacaucgucaaacucaccacauaucgucaaaacugccacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacacggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57522 - RNA, 1758 nt, Artificial Sequence; identical to SEQ ID NO: 57230
  hemagglutinin__InfluenzaB__AGX16006

SEQ ID NO: 57523 - RNA, 1758 nt, Artificial Sequence
  hemagglutinin__InfluenzaB__AGX16017
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57524 - RNA, 1755 nt, Artificial Sequence; identical to SEQ ID NO: 57159
  hemagglutinin__InfluenzaB__AGX16028

SEQ ID NO: 57525 - RNA, 1755 nt, Artificial Sequence
  hemagglutinin__InfluenzaB__AGX16039
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaagucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccguggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57526 - RNA, 1755 nt, Artificial Sequence
  hemagglutinin__InfluenzaB__AGX16050
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuggauguggccuugggcagaccaaugugugugggaaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57527 - RNA, 1755 nt, Artificial Sequence
  hemagglutinin__InfluenzaB__AGX16061
augaaggcaauaauuguacuacucaugguaguaacauccaaugcagaucgaaucugcacugggauaacaucuucaaacucaccucauguggucaaaacagccacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacaucugggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugcccuuaauuggugaagcagauugccuucaugaaaaauacgguggauuaaacaaaagcaagccuuacuacacaggagaacaugcaaaagccauaggaaauugcccaauaugggugaaaacaccuuugaaacuugccaauggaaccaaauauagacccccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggauguuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57528 - RNA, 1755 nt, Artificial Sequence
  hemagglutinin__InfluenzaB__AGX16083
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacgucaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcggcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57529 - RNA, 1755 nt, Artificial Sequence
  hemagglutinin__InfluenzaB__AGX16105
augaaggcaauaauuguacuacucaugguaguaacauccaaugcagaucgaaucugcacugggauaacaucuucaagcucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucagcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacagugaaauacucgagcuggaugagaaaguggaugaucucagagcugacacuauaagcucgcaaauagaacuugcagucuugcuuuccaacgaaggaauaauaaacagugaagaugagcaucuacuggcacuugagagaaagcuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57530 - RNA, 1755 nt, Artificial Sequence
  hemagglutinin__InfluenzaB__AGX16116
augaaggcaauaauuguacuacucaugguaguaacauccaaugcagaucgaaucugcacugggauaacaucuucaaacucaccucauguggucaaaacagcuacacaaggggaggucaaugugacugguguaauaccacugacaacaacaccaacaaaaucuuauuuugcaaaucucaaaggaacaaggaccagagggaaacuauguccagacugucucaacuguacagaucuagauguggccuugggcagaccaaugugugugggaaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauucuucgcaacaauggcuugggcugucccaaaggacaacaacaaaaaugcaacgaacccacuaacaguagaaguaccauacguuuguacggaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaauaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57531 - RNA, 1755 nt, Artificial Sequence
  hemagglutinin__InfluenzaB__AGX16127
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuagauguggccuugggcagaccaaugugugugggaaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauucuucgcaacaauggcuugggcugucccaaaggacaacaacaaaaaugcaacgaacccacuaacaguagaaguaccauacguuuguacggaaggggaagaccaaauuacuguuuggggguuccauucagauaacaaaauccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaauaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57532 - RNA, 1755 nt, Artificial Sequence; identical to SEQ ID NO: 57530
  hemagglutinin__InfluenzaB__AGX16138

SEQ ID NO: 57533 - RNA, 1755 nt, Artificial Sequence
  hemagglutinin__InfluenzaB__AGX16149
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuuuggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccaccuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57534 - RNA, 1755 nt, Artificial Sequence; identical to SEQ ID NO: 57528
  hemagglutinin__InfluenzaB__AGX16160

SEQ ID NO: 57535 - RNA, 1755 nt, Artificial Sequence
  hemagglutinin__InfluenzaB__AGX16182
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaaucacuguuuggggguuccauucugauaacaaaacccaaaugaagaaccucuauggagacucaaauccucaaaaguucaccucaucugcuaauggaguaaccacacacuauguuucucagauuggcggcuucccagaucaaacagaagacggagggcuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuuaccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugaaagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57536 - RNA, 1755 nt, Artificial Sequence
  hemagglutinin__InfluenzaB__AGX16193
augaaggcaauaauuguacuacucaugguaguaacauccaaugcagaucgaaucugcacugggauaacaucuucaaacucaccucauguggucaaaacagcuacucaaggggaggucaaugugacuggugugauaccacuuacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57537 - RNA, 1755 nt, Artificial Sequence
  hemagglutinin__InfluenzaB__AGX16215
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57538 - RNA, 1755 nt, Artificial Sequence
  hemagglutinin__InfluenzaB__AGX16226
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccauaugucuauaa

SEQ ID NO: 57539 - RNA, 1755 nt, Artificial Sequence
  hemagglutinin__InfluenzaB__AGX16237
augaaggcaauaauuguacuacucaugguaguaacauccaaugcagaucgaaucugcacugggauaacaucuucaaacucaccucauguggucaaaacagccacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacaucugggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucacugcccuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcggcagaccucaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggauguuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuauaacauugaugcuagcuauuuuuauuguuuauauggucuccagagacaacguuucaugcuccaucugucuauaa

SEQ ID NO: 57540 - RNA, 1755 nt, Artificial Sequence
  hemagglutinin__InfluenzaB__AGX16248
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57541 - RNA, 1755 nt, Artificial Sequence
  hemagglutinin__InfluenzaB__AGX16259
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccugucacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57542 - RNA, 1755 nt, Artificial Sequence
  hemagglutinin__InfluenzaB__AGX16270
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagagguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugauacaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57543 - RNA, 1755 nt, Artificial Sequence; identical to SEQ ID NO: 57542
  hemagglutinin__InfluenzaB__AGX16281

SEQ ID NO: 57544 - RNA, 1755 nt, Artificial Sequence
  hemagglutinin__InfluenzaB__AGX16292
augaaggcaauaauuguacuacucaugguaguaacauccaaugcagaucgaaucugcacugggauaacaucuucaaacucaccccauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaaaccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucaaauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggggccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57545 - RNA, 1758 nt, Artificial Sequence
  hemagglutinin__InfluenzaB__AGX16303
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacuguacagaucuggacguggccuugggcagaccaaaaugcacggggaacauacccucagcaagaguuucaauacuccaugaagucaggccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaaugggaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauucucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57546 - RNA, 1755 nt, Artificial Sequence
  hemagglutinin__InfluenzaB__AGX16314
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggauuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaauaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacugaagaaaaugcugggucccucugcuguagacauaggaaauggaugcuucgaaaccaaacacaaaugcaaccagaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 57547 - RNA, 1755 nt, Artificial Sequence
  hemagglutinin__InfluenzaB__AGX16325
augaaggcaauaauuguacuacucaugguaguaacauccaaugcagaccgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57548 - RNA, 1755 nt, Artificial Sequence
  hemagglutinin__InfluenzaB__AGX16336
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccgggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57549 - RNA, 1755 nt, Artificial Sequence; identical to SEQ ID NO: 57548
  hemagglutinin__InfluenzaB__AGX16347

SEQ ID NO: 57550 - RNA, 1755 nt, Artificial Sequence; identical to SEQ ID NO: 57548
  hemagglutinin__InfluenzaB__AGX16358

SEQ ID NO: 57551 - RNA, 1755 nt, Artificial Sequence
  hemagglutinin__InfluenzaB__AGX16369
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggagggcccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57552 - RNA, 1755 nt, Artificial Sequence
  hemagglutinin__InfluenzaB__AGX16380
augaaggcaauaguuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaaugugugugggggccacaccuucggcgaaagcuucaauacuccaugaagucagaccuguuacauccgggugcuuuccuaugaugcacgacagaacaaaaaucaggcaacuacccaaucuucucagaggauaugaaaauaucagguuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccacucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaagaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57553 - RNA, 1755 nt, Artificial Sequence
  hemagglutinin__InfluenzaB__AGX16391
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggacuacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuuguccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacgccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57554 - RNA, 1755 nt, Artificial Sequence
  hemagglutinin__InfluenzaB__AGX16402
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaggcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaccccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57555 - RNA, 1755 nt, Artificial Sequence
  hemagglutinin__InfluenzaB__AGX16413
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57556 - RNA, 1755 nt, Artificial Sequence
  hemagglutinin__InfluenzaB__AGX16423
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggugacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57557 - RNA, 1755 nt, Artificial Sequence
  hemagglutinin__InfluenzaB__AGX16434
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaacccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaagugauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57558 - RNA, 1755 nt, Artificial Sequence; identical to SEQ ID NO: 57330
  hemagglutinin__InfluenzaB__AGX16445

SEQ ID NO: 57559 - RNA, 1755 nt, Artificial Sequence
  hemagglutinin__InfluenzaB__AGX16456
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaagacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57560 - RNA, 1755 nt, Artificial Sequence
  hemagglutinin__InfluenzaB__AGX16467
augaaggcaauaauuguacuacucaugguaguaacauccaaugcagaucgaaucugcacuggaauaacauccucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaggguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57561 - RNA, 1755 nt, Artificial Sequence
  hemagglutinin__InfluenzaB__AGX16478
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuuugcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 57562 - RNA, 1755 nt, Artificial Sequence
  hemagglutinin__InfluenzaB__AGX16489
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagaggaaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaagcuauuaaaggaaagggguuucuucggagcuauugcugguuuccuagaaggaggaugggaaggaaugauugcaggcuggcacggauacacaucucacggagcacauggaguggcaguggcggcggaccuuaagagcacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57563 - RNA, 1758 nt, Artificial Sequence
  hemagglutinin__InfluenzaB__AGX16500
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57564 - RNA, 1758 nt, Artificial Sequence; identical to SEQ ID NO: 57563
  hemagglutinin__InfluenzaB__AGX16511

SEQ ID NO: 57565 - RNA, 1758 nt, Artificial Sequence; identical to SEQ ID NO: 57563
  hemagglutinin__InfluenzaB__AGX16522

SEQ ID NO: 57566 - RNA, 1758 nt, Artificial Sequence
  hemagglutinin__InfluenzaB__AGX16533
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaaagaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57567 - RNA, 1758 nt, Artificial Sequence
  hemagglutinin__InfluenzaB__AGX16555
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaagcccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57568 - RNA, 1758 nt, Artificial Sequence
  hemagglutinin__InfluenzaB__AGX16566
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57569 - RNA, 1758 nt, Artificial Sequence
  hemagglutinin__InfluenzaB__AGX16577
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57570 - RNA, 1758 nt, Artificial Sequence
  hemagglutinin__InfluenzaB__AGX16588
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuauagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57571 - RNA, 1758 nt, Artificial Sequence
  hemagglutinin__InfluenzaB__AGX16599
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacgugucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57572 - RNA, 1758 nt, Artificial Sequence
  hemagglutinin__InfluenzaB__AGX16610
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaaagaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57573 - RNA, 1758 nt, Artificial Sequence
  hemagglutinin__InfluenzaB__AGX16621
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggaguuaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57574 - RNA, 1758 nt, Artificial Sequence
  hemagglutinin__InfluenzaB__AGX16654
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaauaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacaugguacaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuauagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57575 - RNA, 1758 nt, Artificial Sequence
  hemagglutinin__InfluenzaB__AGX16665
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaauggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaagaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57576 - RNA, 1758 nt, Artificial Sequence
  hemagglutinin__InfluenzaB__AGX16676
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57577 - RNA, 1758 nt, Artificial Sequence
  hemagglutinin__InfluenzaB__AGX16687
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57578 - RNA, 1758 nt, Artificial Sequence; identical to SEQ ID NO: 57571
  hemagglutinin__InfluenzaB__AGX16698

SEQ ID NO: 57579 - RNA, 1758 nt, Artificial Sequence
  hemagglutinin__InfluenzaB__AGX16709
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggagaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaagugguaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcacuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57580 - RNA, 1758 nt, Artificial Sequence; identical to SEQ ID NO: 57577
  hemagglutinin__InfluenzaB__AGX16720

SEQ ID NO: 57581 - RNA, 1758 nt, Artificial Sequence; identical to SEQ ID NO: 57569
  hemagglutinin__InfluenzaB__AGX16731

SEQ ID NO: 57582 - RNA, 1758 nt, Artificial Sequence
  hemagglutinin__InfluenzaB__AGX16742
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauaauccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57583 - RNA, 1758 nt, Artificial Sequence; identical to SEQ ID NO: 57563
  hemagglutinin__InfluenzaB__AGX16753

SEQ ID NO: 57584 - RNA, 1758 nt, Artificial Sequence; identical to SEQ ID NO: 57569
  hemagglutinin__InfluenzaB__AGX16764

SEQ ID NO: 57585 - RNA, 1758 nt, Artificial Sequence
  hemagglutinin__InfluenzaB__AGX16775
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaacuagagggaaacuaugcccaaaaugccucaacugcacagauuuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggacuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57586 - RNA, 1758 nt, Artificial Sequence
  hemagglutinin__InfluenzaB__AGX16797
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacaugcccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57587 - RNA, 1758 nt, Artificial Sequence; identical to SEQ ID NO: 57571
  hemagglutinin__InfluenzaB__AGX16808

SEQ ID NO: 57588 - RNA, 1758 nt, Artificial Sequence
  hemagglutinin__InfluenzaB__AGX16819
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaagugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauagcgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcuaggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuauuguuuauauggucuccagagacaauguuucuugcuccaucugucuauaa

SEQ ID NO: 57589 - RNA, 1758 nt, Artificial Sequence; identical to SEQ ID NO: 57571
  hemagglutinin__InfluenzaB__AGX16830

SEQ ID NO: 57590 - RNA, 1758 nt, Artificial Sequence
  hemagglutinin__InfluenzaB__AGX16841
augaaagcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggaaugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaccucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaauggcgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57591 - RNA, 1758 nt, Artificial Sequence
  hemagglutinin__InfluenzaB__AGX16852
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagaauaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57592 - RNA, 1758 nt, Artificial Sequence; identical to SEQ ID NO: 57571
  hemagglutinin__InfluenzaB__AGX16863

SEQ ID NO: 57593 - RNA, 1758 nt, Artificial Sequence; identical to SEQ ID NO: 57577
  hemagglutinin__InfluenzaB__AGX16874

SEQ ID NO: 57594 - RNA, 1758 nt, Artificial Sequence
  hemagglutinin__InfluenzaB__AGX16885
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuauagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57595 - RNA, 1758 nt, Artificial Sequence; identical to SEQ ID NO: 57594
  hemagglutinin__InfluenzaB__AGX16896

SEQ ID NO: 57596 - RNA, 1758 nt, Artificial Sequence
  hemagglutinin__InfluenzaB__AGX16907
augaaggcaauaauuguacuacucaugguaguaacauccaaugcagauagaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacgugucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57597 - RNA, 1758 nt, Artificial Sequence
  hemagglutinin__InfluenzaB__AGX16918
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaaacucuauggggacucaaagccccagaaguucaccucaucugccaacggagugaccacacauuacgugucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57598 - RNA, 1758 nt, Artificial Sequence; identical to SEQ ID NO: 57563
  hemagglutinin__InfluenzaB__AGX16940

SEQ ID NO: 57599 - RNA, 1758 nt, Artificial Sequence; identical to SEQ ID NO: 57594
  hemagglutinin__InfluenzaB__AGX16951

SEQ ID NO: 57600 - RNA, 1758 nt, Artificial Sequence
  hemagglutinin__InfluenzaB__AGX16962
augaaggcaauaauuguacuacucaugguaguaacauccaaugcagaucgaaucugcacugggauaacaucgucaaacucaccccauguggucaaaacugcuacucaaggggaggucaaugugacuggugugauaccacuaacaacaacacccaccgaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaaaagaagacggaggacuaccacaaagugguagaauuguuguugauuacauggugcaaaaaucugggaacacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57601 - RNA, 1758 nt, Artificial Sequence
  hemagglutinin__InfluenzaB__AGX16973
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaauguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacgugucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggguuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57602 - RNA, 1758 nt, Artificial Sequence
  hemagglutinin__InfluenzaB__AGX16995
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggaccuuacaaaauuggaaccucagggucuugcccuaacguuaccaauggaaacggauuuuuugcaacaauggcuugggccgucccaaaaaacgacaacaacaaaacagcaacaaauucauuaacaguagaaguaccauacauuuguacagaaggagaagaccaaauuaccguuuggggguuccacucugauaacgaaauccaaauggcaaaacucuauggggacucaaagccccagaaguucaccucaucugccaacggaguuaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57603 - RNA, 1758 nt, Artificial Sequence
  hemagglutinin__InfluenzaB__AGX17006
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaaaccaaauggcaaaacucuauggggacucaaagccccagaaguucaccucaucugccaacggagugaccacacauuacgugucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuucuaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57604 - RNA, 1758 nt, Artificial Sequence; identical to SEQ ID NO: 57569
  hemagglutinin__InfluenzaB__AGX17017

SEQ ID NO: 57605 - RNA, 1758 nt, Artificial Sequence
  hemagglutinin__InfluenzaB__AGX17028
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagagguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57606 - RNA, 1758 nt, Artificial Sequence
  hemagglutinin__InfluenzaB__AGX17039
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccgaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacacuacguuucacagauugguggcuucccaaaucaaacagaagacggaggacuaccacaaagugguagaauuguuguugauuacauggugcaaaaaucugggaacacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauaaugcuuuacuacucaacugcugccuccaguuuggcuguaacauugaugauagcuaucuuuguuguuuauauggucuccagagacaauguuucuugcuccaucugucuauaa

SEQ ID NO: 57607 - RNA, 1758 nt, Artificial Sequence
  hemagglutinin__InfluenzaB__AGX17050
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacaguugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57608 - RNA, 1758 nt, Artificial Sequence
  hemagglutinin__InfluenzaB__AGX17061
augaaggcaauaauuguacuacucaugguaguaacauccaaugcagaucgaaucugcacuggaauaacaucgucaaacucaccccauguggucaaaacugcuacucaaggggaagucaaugugacuggugugauaccacugacaacaacacccaccaaaucucauuuugcaaaucucaaaggaacaaaaaccagagggaaacuaugcccaaaaugucucaacugcacugaucuggacguggccuugggcagaccaaaaugcacggggaauauaccuucggcaaaaguuucaauacuccaugaaguaagaccuguuacaucugggugcuuuccuauaaugcacgacagaacaaaaauuagacagcugcccaaucuucucagaggauacgaacguaucagguuaucaaaccauaacguuaucaaugcagaaaaagcaccaggaggacccuacaaaauuggaaccucagggucuugcccuaacguuaccaauggaaacggauucuucgcaacaauggcuugggcugucccaaaaaacgaaaacaacaaaacagcaacaaauucauuaacaauagaaguaccauacauuuguacagaaggagaagaccaaauuaccguuuggggguuccacucugauaacgaaacccaaauggcaaaacucuauggagacucaaagccucagaaauucacuucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuauacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggagcacauggaguagcaguggcagcagaccuuaagaguacucaagaagccauaaacaagaucacaaaaaaucucaacucuuugagugagcuggaaguaaagaaucuucaaagacuaagcggagccauggaugaacuccacaacgaaauacuagaacuagaugagaaaguggaugaucucagagcugauacaauaagcucgcaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugccucgacagaauagcugcuggcaccuuuaaugcaggagaauuuucucuccccaccuuugauucacuaaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuuccuguuccaucugucuauaa

SEQ ID NO: 57609 - RNA, 1758 nt, Artificial Sequence
  hemagglutinin__InfluenzaB__AGX17072
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccgaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaacacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57610 - RNA, 1758 nt, Artificial Sequence; identical to SEQ ID NO: 57594
  hemagglutinin__InfluenzaB__AGX17083

SEQ ID NO: 57611 - RNA, 1758 nt, Artificial Sequence
  hemagglutinin__InfluenzaB__AGX17094
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauagcgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57612 - RNA, 1758 nt, Artificial Sequence
  hemagglutinin__InfluenzaB__AGX17105
augaaggcaauaauuguacuacucaugguaguaacauccaaugcagaucgaaucugcacugggauaacaucgucaaacucaccccauguggucaaaacugcuacucaaggggagaucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccacacauuuguacagaaggagaagaccaaauuaccguuuggggguuccacucugauaacgaaauccaaauggcaaaacucuauggggacucaaagccccagaaguucaccucaucugccaacggagugaccacacauuacauuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuauagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57613 - RNA, 1758 nt, Artificial Sequence; identical to SEQ ID NO: 57594
  hemagglutinin__InfluenzaB__AGX17116

SEQ ID NO: 57614 - RNA, 1758 nt, Artificial Sequence
  hemagglutinin__InfluenzaB__AGX17127
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccgaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaaaccaaauggcaaaacucuauggggacucaaagccccagaaguucaccucuucugccaacggagugaccacacauuacguuucacagauugguggcuucccaaaucaaacagaagacggaggacuaccacaaagugguagaauuguuguugauuacauggugcaaaaaucugggaacacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggguuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57615 - RNA, 1758 nt, Artificial Sequence
  hemagglutinin__InfluenzaB__AGX17138
augaaggcaauaauuguacuacucaugguaguaacauccaaugcagaucgaaucugcacugggauaacaucgucaaacucaccccauguggucaaaacugcuacucaaggggaggucaaugugacuggugugauaccauugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaagucucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaaucaccguuuggggguuccacucugauaacgaaaaccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57616 - RNA, 1758 nt, Artificial Sequence
  hemagglutinin__InfluenzaB__AGX17149
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacgauggcuugggccgucccaaaaaacgacaacaacaaaacagcaacaaauucauuaacaauagaaguaccauacauuuguacagaaggagaagaccaaauuaccguuuggggguuccacucugauaacgaaaaccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57617 - RNA, 1758 nt, Artificial Sequence
  hemagglutinin__InfluenzaB__AGX17160
augaaggcaauaauuguacuacucaugguaguaacauccaaugcagaucgaaucugcacugggauaacaucgucaaacucaccccauguggucaaaacugcuacucaaggggaggucaaugugacugguaugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauuaaugauagcuaucuuuguuguuuauauggucuccagagacaauguuucuugcuccaucugucuauaa

SEQ ID NO: 57618 - RNA, 1758 nt, Artificial Sequence
  hemagglutinin__InfluenzaB__AGX17171
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccgaaucucauuuugcaaaucucaaaggaacaaaaaccagagggaaacuaugcccaaaaugccucaacugcacagaucuggacguggcuuugggcagaccaaaaugcacggggaacauacccucggcaaaaguuucaauacuccaugaagucagaccuguuacaucugggugcuuuccuauaaugcacaacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaagcccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaacacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57619 - RNA, 1758 nt, Artificial Sequence
  hemagglutinin__InfluenzaB__AGX17182
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuaucgcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57620 - RNA, 1758 nt, Artificial Sequence; identical to SEQ ID NO: 57563
  hemagglutinin__InfluenzaB__AGX17193

SEQ ID NO: 57621 - RNA, 1758 nt, Artificial Sequence; identical to SEQ ID NO: 57619
  hemagglutinin__InfluenzaB__AGX17204

SEQ ID NO: 57622 - RNA, 1758 nt, Artificial Sequence
  hemagglutinin__InfluenzaB__AGX17215
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaagcccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuauagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57623 - RNA, 1758 nt, Artificial Sequence
  hemagglutinin__InfluenzaB__AGX17226
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagagguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcuaaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57624 - RNA, 1758 nt, Artificial Sequence
  hemagglutinin__InfluenzaB__AGX17237
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacauuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaacuaaauauagaccuccugcaaaacuauuaaaggaaagggguuucuucggggcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57625 - RNA, 1758 nt, Artificial Sequence
  hemagglutinin__InfluenzaB__AGX17248
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcacaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57626 - RNA, 1758 nt, Artificial Sequence
  hemagglutinin__InfluenzaB__AGX17270
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaagcccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuucuaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57627 - RNA, 1758 nt, Artificial Sequence
  hemagglutinin__InfluenzaB__AGX17281
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccuggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57628 - RNA, 1758 nt, Artificial Sequence; identical to SEQ ID NO: 57627
  hemagglutinin__InfluenzaB__AGX17292

SEQ ID NO: 57629 - RNA, 1758 nt, Artificial Sequence
  hemagglutinin__InfluenzaB__AGX17303
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggaguuaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaaacugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57630 - RNA, 1758 nt, Artificial Sequence; identical to SEQ ID NO: 57609
  hemagglutinin__InfluenzaB__AGX17314

SEQ ID NO: 57631 - RNA, 1758 nt, Artificial Sequence; identical to SEQ ID NO: 57563
  hemagglutinin__InfluenzaB__AGX17325

SEQ ID NO: 57632 - RNA, 1758 nt, Artificial Sequence; identical to SEQ ID NO: 57594
  hemagglutinin__InfluenzaB__AGX17336

SEQ ID NO: 57633 - RNA, 1758 nt, Artificial Sequence; identical to SEQ ID NO: 57605
  hemagglutinin__InfluenzaB__AGX17347

SEQ ID NO: 57634 - RNA, 1758 nt, Artificial Sequence
  hemagglutinin__InfluenzaB__AGX17358
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugcuauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57635 - RNA, 1758 nt, Artificial Sequence
  hemagglutinin__InfluenzaB__AGX17369
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucaggaucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguugcugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57636 - RNA, 1758 nt, Artificial Sequence; identical to SEQ ID NO: 57609
  hemagglutinin__InfluenzaB__AGX17380

SEQ ID NO: 57637 - RNA, 1758 nt, Artificial Sequence; identical to SEQ ID NO: 57483
  hemagglutinin__InfluenzaB__AGX17391

SEQ ID NO: 57638 - RNA, 1758 nt, Artificial Sequence
  hemagglutinin__InfluenzaB__AGX17400
augaaggcaauaauuguacuacucaugguaguaacauccaaugcagaucgaaucugcacugggauaacaucgucaaacucaccccauauggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagagguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57639 - RNA, 1758 nt, Artificial Sequence
  hemagglutinin__InfluenzaB__AGX17411
augaaggcaauaauuguacuacucaugguaguaacauccaaugcagaucgaaucugcacugggauaacaucgucaaacucaccccauguggucaaaacugcuacucaaggggaggucaaugugacuggugugauaccacuaacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57640 - RNA, 1758 nt, Artificial Sequence
  hemagglutinin__InfluenzaB__AGX17422
augaaagcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagagguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57641 - RNA, 1758 nt, Artificial Sequence
  hemagglutinin__InfluenzaB__AGX17433
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagggggaaacuaugcccaaaaugccucaacugcacagaucuggacguggccuugggcagaccgaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaaagaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaagugguaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57642 - RNA, 1758 nt, Artificial Sequence; identical to SEQ ID NO: 57605
  hemagglutinin__InfluenzaB__AGX17444

SEQ ID NO: 57643 - RNA, 1758 nt, Artificial Sequence
  hemagglutinin__InfluenzaB__AGX17455
augaaggcaauaauuguacuacucaugguaguaacauccaaugcagaucgaaucugcacugggauaacaucgucaaacucaccccauguggucaaaacugcuacucaaggggaggucaaugugacuggugugauaccacuaacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucggauaaagaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57644 - RNA, 1758 nt, Artificial Sequence; identical to SEQ ID NO: 57609
  hemagglutinin__InfluenzaB__AGX17466

SEQ ID NO: 57645 - RNA, 1758 nt, Artificial Sequence
  hemagglutinin__InfluenzaB__AGX17477
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagaggaaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggauuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagagggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57646 - RNA, 1758 nt, Artificial Sequence
  hemagglutinin__InfluenzaB__AGX17488
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauaugaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaaacucuauggggacucaaagccccagaaguucaccucaucugccaacggagugaccacacauuacgugucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57647 - RNA, 1758 nt, Artificial Sequence
  hemagglutinin__InfluenzaB__AGX17499
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaaucagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggggaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauag

SEQ ID NO: 57648 - RNA, 1758 nt, Artificial Sequence
  hemagglutinin__InfluenzaB__AGX17510
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccgaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaacacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuagaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57649 - RNA, 1758 nt, Artificial Sequence; identical to SEQ ID NO: 57609
  hemagglutinin__InfluenzaB__AGX17521

SEQ ID NO: 57650 - RNA, 1758 nt, Artificial Sequence
  hemagglutinin__InfluenzaB__AGX17532
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauagcgaaacccaaauggcaaaacucuauggggacucaaagccccagaaguucaccucaucugccaacggagugaccacacauuacgugucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaaggggcuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57651 - RNA, 1758 nt, Artificial Sequence
  hemagglutinin__InfluenzaB__AGX17543
augaaggcaauaauuguacuacuaaugguaguaacauccaaugcagaucgaaucugcacugggauaacaucgucaaacucaccccauguggucaaaacugcuacucaaggggaggucaaugugacuggggugauaccacugacaacaacacccaccaaaucucauuuugcaagucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccaugaaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucucccuacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauag

SEQ ID NO: 57652 - RNA, 1758 nt, Artificial Sequence
  hemagglutinin__InfluenzaB__AGX17554
augaaggcaauaauuguacuacucuugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57653 - RNA, 1755 nt, Artificial Sequence; identical to SEQ ID NO: 57533
  hemagglutinin__InfluenzaB__AGX17565

SEQ ID NO: 57654 - RNA, 1758 nt, Artificial Sequence
  hemagglutinin__InfluenzaB__AGX17576
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacacaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagagguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauggcuaucuuuguuguuuauauggucuccagagacaauguuucuugcuccaucugucuauaa

SEQ ID NO: 57655 - RNA, 1758 nt, Artificial Sequence
  hemagglutinin__InfluenzaB__AGX17598
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaagucucauuuugcaaaucucaaaggaacagaaaccagagggaaacuaugcccaaaaugccucaacugcacagaucuggacguggccuugggcaggccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaccucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57656 - RNA, 1758 nt, Artificial Sequence
  hemagglutinin__InfluenzaB__AGX17609
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57657 - RNA, 1758 nt, Artificial Sequence; identical to SEQ ID NO: 57485
  hemagglutinin__InfluenzaB__AGX17620

SEQ ID NO: 57658 - RNA, 1758 nt, Artificial Sequence
  hemagglutinin__InfluenzaB__AGX17631
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57659 - RNA, 1758 nt, Artificial Sequence
  hemagglutinin__InfluenzaB__AGX17642
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57660 - RNA, 1758 nt, Artificial Sequence
  hemagglutinin__InfluenzaB__AGX17653
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacagcacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaccugggaaaacaggaacaauuaccuaucaaagagguauuuuauuaccucaaaaaguguggugugcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcagugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugaugauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57661 - RNA, 1758 nt, Artificial Sequence; identical to SEQ ID NO: 57658
  hemagglutinin__InfluenzaB__AGX17664

SEQ ID NO: 57662 - RNA, 1758 nt, Artificial Sequence
  hemagglutinin__InfluenzaB__AGX17675
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagagguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57663 - RNA, 1758 nt, Artificial Sequence; identical to SEQ ID NO: 57485
  hemagglutinin__InfluenzaB__AGX17686

SEQ ID NO: 57664 - RNA, 1758 nt, Artificial Sequence
  hemagglutinin__InfluenzaB__AGX17697
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacgggggaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacgcuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57665 - RNA, 1758 nt, Artificial Sequence; identical to SEQ ID NO: 57659
  hemagglutinin__InfluenzaB__AGX17708

SEQ ID NO: 57666 - RNA, 1758 nt, Artificial Sequence
  hemagglutinin__InfluenzaB__AGX17719
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacagcacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggcagucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaccugggaaaacaggaacaauuaccuaucaaagagguauuuuauugccucaaaaaguguggugugcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcagugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugaugauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57667 - RNA, 1758 nt, Artificial Sequence; identical to SEQ ID NO: 57662
  hemagglutinin__InfluenzaB__AGX17730

SEQ ID NO: 57668 - RNA, 1758 nt, Artificial Sequence; identical to SEQ ID NO: 57658
  hemagglutinin__InfluenzaB__AGX17741

SEQ ID NO: 57669 - RNA, 1758 nt, Artificial Sequence; identical to SEQ ID NO: 57485
  hemagglutinin__InfluenzaB__AGX17752

SEQ ID NO: 57670 - RNA, 1758 nt, Artificial Sequence
  hemagglutinin__InfluenzaB__AGX17774
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacagcacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaccugggaaaacaggaacaauuaccuaucaaagagguauuuuauugccucaaaaaguguggugugcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcaguggcagcagaccuuaagagcacucaagaagccauaaacaagauaacaaaaaaucucaacucuuugagugagcuggaaguaaagaaucuucaaagacuaagcagugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugaugauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57671 - RNA, 1758 nt, Artificial Sequence
  hemagglutinin__InfluenzaB__AGX17785
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacaugucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57672 - RNA, 1758 nt, Artificial Sequence; identical to SEQ ID NO: 57485
  hemagglutinin__InfluenzaB__AGX17796

SEQ ID NO: 57673 - RNA, 1758 nt, Artificial Sequence
  hemagglutinin__InfluenzaB__AGX17807
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57674 - RNA, 1758 nt, Artificial Sequence
  hemagglutinin__InfluenzaB__AGX17818
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauaugaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57675 - RNA, 1758 nt, Artificial Sequence
  hemagglutinin__InfluenzaB__AGX17829
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccguaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57676 - RNA, 1758 nt, Artificial Sequence
  hemagglutinin__InfluenzaB__AGX17840
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacugccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguguauauggucuccagagacaauguuucuugcuccaucugucuauaa

SEQ ID NO: 57677 - RNA, 1758 nt, Artificial Sequence; identical to SEQ ID NO: 57670
  hemagglutinin__InfluenzaB__AGX17851

SEQ ID NO: 57678 - RNA, 1758 nt, Artificial Sequence
  hemagglutinin__InfluenzaB__AGX17862
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggaaccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57679 - RNA, 1758 nt, Artificial Sequence
  hemagglutinin__InfluenzaB__AGX17873
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucgacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugacaacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57680 - RNA, 1758 nt, Artificial Sequence; identical to SEQ ID NO: 57659
  hemagglutinin__InfluenzaB__AGX17884

SEQ ID NO: 57681 - RNA, 1758 nt, Artificial Sequence
  hemagglutinin__InfluenzaB__AGX17895
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggcagucccaaaaaacgacaacaacaaaacagcaacaaauucauuaacaauagaaguaccauacauuuguacagaaggagaagaccaaauuaccguuuggggguuccacucugauaacgaaaaccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaauuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57682 - RNA, 1758 nt, Artificial Sequence
  hemagglutinin__InfluenzaB__AGX17906
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuauacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57683 - RNA, 1758 nt, Artificial Sequence; identical to SEQ ID NO: 57659
  hemagglutinin__InfluenzaB__AGX17917

SEQ ID NO: 57684 - RNA, 1758 nt, Artificial Sequence
  hemagglutinin__InfluenzaB__AGX17928
augaagacaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggaaccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57685 - RNA, 1758 nt, Artificial Sequence
  hemagglutinin__InfluenzaB__AGX17939
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaaguugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57686 - RNA, 1758 nt, Artificial Sequence; identical to SEQ ID NO: 57658
  hemagglutinin__InfluenzaB__AGX17950

SEQ ID NO: 57687 - RNA, 1758 nt, Artificial Sequence; identical to SEQ ID NO: 57658
  hemagglutinin__InfluenzaB__AGX17961

SEQ ID NO: 57688 - RNA, 1758 nt, Artificial Sequence
  hemagglutinin__InfluenzaB__AGX17972
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacagcacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggauucccaaaucaaacagaagacggaggacuaccacaaagugguagaauuguuguugauuacauggugcaaaaaccugggaaaacaggaacaauuaccuaucaaagagguauuuuauugccucaaaaaguguggugugcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcagugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugaugauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57689 - RNA, 1758 nt, Artificial Sequence; identical to SEQ ID NO: 57658
  hemagglutinin__InfluenzaB__AGX17983

SEQ ID NO: 57690 - RNA, 1758 nt, Artificial Sequence; identical to SEQ ID NO: 57659
  hemagglutinin__InfluenzaB__AGX17994

SEQ ID NO: 57691 - RNA, 1758 nt, Artificial Sequence
  hemagglutinin__InfluenzaB__AGX18005
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuacuaaaggaaagggguuucuucggagcuauugcugguuucuuagaaggaggaugggaaggaaugauugcagguuggcacggauacacaucccauggggcacauggaguagcgguggcagcagacauuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57692 - RNA, 1758 nt, Artificial Sequence
  hemagglutinin__InfluenzaB__AGX18016
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguauagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57693 - RNA, 1758 nt, Artificial Sequence
  hemagglutinin__InfluenzaB__AGX18027
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaaaauacccucggcaagaguuucaauacuccaugaagucagaccuguuacaucugggugcuuuccuauaaugcacgacagaacaaaaaucagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57694 - RNA, 1758 nt, Artificial Sequence
  hemagglutinin__InfluenzaB__AGX18038
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauaugguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57695 - RNA, 1758 nt, Artificial Sequence
  hemagglutinin__InfluenzaB__AGX18049
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagaggaaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccaugaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57696 - RNA, 1758 nt, Artificial Sequence; identical to SEQ ID NO: 57662
  hemagglutinin__InfluenzaB__AGX18060

SEQ ID NO: 57697 - RNA, 1758 nt, Artificial Sequence; identical to SEQ ID NO: 57658
  hemagglutinin__InfluenzaB__AGX18071

SEQ ID NO: 57698 - RNA, 1758 nt, Artificial Sequence
  hemagglutinin__InfluenzaB__AGX18082
augaaggcaauaauuguacuacucaugguaguaacauccaaugcagaucgaaucugcaccgggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggaaccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57699 - RNA, 1758 nt, Artificial Sequence
  hemagglutinin__InfluenzaB__AGX18093
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggaaccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucucccaacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57700 - RNA, 1758 nt, Artificial Sequence
  hemagglutinin__InfluenzaB__AGX18104
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacagcacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaccugggaaaacaggaacaauuaccuaucaaagagguauuuuauugccucaaaaaguguggugugcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcagugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugaugauggauuggauaaucauacuauacugcuuuacuacucaacugcugccuccaguuuggcuguaacauuaaugauagcuaucuuuguuguuuauauggucuccagagacaauguuucuugcuccaucugucuauaa

SEQ ID NO: 57701 - RNA, 1758 nt, Artificial Sequence
  hemagglutinin__InfluenzaB__AGX18115
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuuuggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57702 - RNA, 1758 nt, Artificial Sequence; identical to SEQ ID NO: 57662
  hemagglutinin__InfluenzaB__AGX18126

SEQ ID NO: 57703 - RNA, 1758 nt, Artificial Sequence
  hemagglutinin__InfluenzaB__AGX18137
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucgcagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuaccgcugcaucuuuaaaugacgauggauuagauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57704 - RNA, 1758 nt, Artificial Sequence
  hemagglutinin__InfluenzaB__AGX18148
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggaaccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauag

SEQ ID NO: 57705 - RNA, 1758 nt, Artificial Sequence
  hemagglutinin__InfluenzaB__AGX18159
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuagauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57706 - RNA, 1758 nt, Artificial Sequence
  hemagglutinin__InfluenzaB__AGX18170
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacagggacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuacuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaccauacuauacugcuuuacuacucaacugcugccuccaguuuggcuguaacauugaugauagcuaucuuuguuguuuauauggucuccagagacaauguuucuugcuccaucugucuauaa

SEQ ID NO: 57707 - RNA, 1758 nt, Artificial Sequence; identical to SEQ ID NO: 57678
  hemagglutinin__InfluenzaB__AGX18181

SEQ ID NO: 57708 - RNA, 1758 nt, Artificial Sequence
  hemagglutinin__InfluenzaB__AGX18192
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucuaccaacggagugaccacacauuacguuucacagauugguggcuucccaaaucaaacagaagauggaggacuaccacaaagugguagaauuguuguugauuacauggugcaaaaaccugggaaaacaggaacaauuaccuaucaaagagguauuuuauugccucaaaaaguguggugugcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcagugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugaugauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57709 - RNA, 1758 nt, Artificial Sequence; identical to SEQ ID NO: 57693
  hemagglutinin__InfluenzaB__AGX18203

SEQ ID NO: 57710 - RNA, 1758 nt, Artificial Sequence
  hemagglutinin__InfluenzaB__AGX18214
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaacuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuuuggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauauuauacugcuuuacuacucaacugcugccuccaguuuggcuguaacauugaugauagcuaucuuuguuguuuauauggucuccagagacaauguuucuugcuccaucugucuauaa

SEQ ID NO: 57711 - RNA, 1758 nt, Artificial Sequence
  hemagglutinin__InfluenzaB__AGX18225
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagagguuucuucggagcuauugcugguuucuuagaaggaggaugggaaggaaugauugcagguuggcacggauacacaucccauggggcacauggaguagcaguggcagcagaccuuaagagcacucaagaagccauaaacaggauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcgguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57712 - RNA, 1758 nt, Artificial Sequence
  hemagglutinin__InfluenzaB__AGX18236
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacaugaugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuauacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57713 - RNA, 1758 nt, Artificial Sequence; identical to SEQ ID NO: 57673
  hemagglutinin__InfluenzaB__AGX18247

SEQ ID NO: 57714 - RNA, 1758 nt, Artificial Sequence
  hemagglutinin__InfluenzaB__AGX18258
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaagucucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaaaaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggaaccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57715 - RNA, 1758 nt, Artificial Sequence; identical to SEQ ID NO: 57705
  hemagglutinin__InfluenzaB__AGX18280

SEQ ID NO: 57716 - RNA, 1758 nt, Artificial Sequence
  hemagglutinin__InfluenzaB__AGX18291
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcguaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57717 - RNA, 1758 nt, Artificial Sequence
  hemagglutinin__InfluenzaB__AGX18302
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaagucucaauacuccaugaagucagaccuguuaccucugggugcuuuccuauaaugcacgacagaacaaaaauuagacagcugcccaaccuucucagaggauacaaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggaaccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57718 - RNA, 1758 nt, Artificial Sequence; identical to SEQ ID NO: 57655
  hemagglutinin__InfluenzaB__AGX18313

SEQ ID NO: 57719 - RNA, 1758 nt, Artificial Sequence
  hemagglutinin__InfluenzaB__AGX18324
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaagcccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuauacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57720 - RNA, 1758 nt, Artificial Sequence
  hemagglutinin__InfluenzaB__AGX18335
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaagucucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggaaccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57721 - RNA, 1758 nt, Artificial Sequence
  hemagglutinin__InfluenzaB__AGX18346
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugaagauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57722 - RNA, 1758 nt, Artificial Sequence
  hemagglutinin__InfluenzaB__AGX18357
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacagcacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaaagaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaccugggaaaacaggaacaauuaccuaucaaagagguauuuuauugccucaaaaaguguggugugcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcagugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugaugauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57723 - RNA, 1758 nt, Artificial Sequence
  hemagglutinin__InfluenzaB__AGX18368
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacagcacccaccaaaucucauuuugcaaaucucaaaggaacaaaaaccagagggaaacuaugcccaaaaugccucaacugcacagaucuggacguggccuugggcagaccaaaaugcacggggaacacacccucggcagaaguuucaauacuccaugaagucagaccuguuaccucugggugcuuuccuauaaugcacgacagaacaaaaauuagacagcugcccaaccuucucagaggauacgaacauaucagauuaucaaaucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaccugggaaaacaggaacaauuaccuaucaaagagguauuuuauugccucaaaaaguguggugugcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcagugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugaugauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57724 - RNA, 1758 nt, Artificial Sequence; identical to SEQ ID NO: 57701
  hemagglutinin__InfluenzaB__AGX18379

SEQ ID NO: 57725 - RNA, 1758 nt, Artificial Sequence
  hemagglutinin__InfluenzaB__AGX18390
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuuugcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggaaccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauag

SEQ ID NO: 57726 - RNA, 1758 nt, Artificial Sequence
  hemagglutinin__InfluenzaB__AGX18401
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacagcacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaauccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaccugggaaaacaggaacaauuaccuaucaaagagguauuuuauugccucaaaaaguguggugugcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcagugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugaugauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57727 - RNA, 1758 nt, Artificial Sequence
  hemagglutinin__InfluenzaB__AGX18412
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaaaucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaagcccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagagguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57728 - RNA, 1758 nt, Artificial Sequence; identical to SEQ ID NO: 57485
  hemagglutinin__InfluenzaB__AGX18423

SEQ ID NO: 57729 - RNA, 1755 nt, Artificial Sequence
  hemagglutinin__InfluenzaB__AGX18424
augaaggcaauaauuguacuacucaugguaguaacauccaacgcagaucgaaucugcacugggauaacaucuucaaacucaccucauguggucaaaacagcuacucaaggggaggucaaugugacuggugugauaccacugacaacaacuccaauaaaaucucauuuugcaaaucucaaaggaacaaggacuagagggaaacuaugcccagauugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcccuaggaggacccuacagacuuggaaccucaggaucuugcccuaacgccaccaguaaaagcggauuuuucgcaacaauggcuugggcugucccaaaggacaacaacaaaaaugcaacgaacccacuaacaguagaaguaccauacaucuguacagaaggggaagaccaaauuacuguuuggggguuccauucagaugacaaaacccaaaugaaaaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggguuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauauugcucuauuacucaacugcugcuucuaguuuggcuguaacauugaugcuagcuauuuuuauuguuuauauggucuccagagacaacguuucaugcuccaucugucuauaa

SEQ ID NO: 57730 - RNA, 1758 nt, Artificial Sequence
  hemagglutinin__InfluenzaB__AGX18435
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagacuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaauccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57731 - RNA, 1758 nt, Artificial Sequence
  hemagglutinin__InfluenzaB__AGX18446
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuuguccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagagguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguggagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57732 - RNA, 1758 nt, Artificial Sequence; identical to SEQ ID NO: 57678
  hemagglutinin__InfluenzaB__AGX18457

SEQ ID NO: 57733 - RNA, 1758 nt, Artificial Sequence; identical to SEQ ID NO: 57485
  hemagglutinin__InfluenzaB__AGX18468

SEQ ID NO: 57734 - RNA, 1758 nt, Artificial Sequence; identical to SEQ ID NO: 57720
  hemagglutinin__InfluenzaB__AGX18479

SEQ ID NO: 57735 - RNA, 1758 nt, Artificial Sequence
  hemagglutinin__InfluenzaB__AGX18490
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacaggacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57736 - RNA, 1758 nt, Artificial Sequence
  hemagglutinin__InfluenzaB__AGX18512
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggagacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57737 - RNA, 1758 nt, Artificial Sequence
  hemagglutinin__InfluenzaB__AGX18523
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57738 - RNA, 1758 nt, Artificial Sequence
  hemagglutinin__InfluenzaB__AGX18534
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaagauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57739 - RNA, 1758 nt, Artificial Sequence
  hemagglutinin__InfluenzaB__AGX18545
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcgaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaagauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauagcgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 57740 - RNA, 1758 nt, Artificial Sequence
  hemagglutinin__InfluenzaB__AGX18556
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57741 - RNA, 1758 nt, Artificial Sequence; identical to SEQ ID NO: 57735
  hemagglutinin__InfluenzaB__AGX18567

SEQ ID NO: 57742 - RNA, 1758 nt, Artificial Sequence
  hemagglutinin__InfluenzaB__AGX18578
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcuuccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggccggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaaagaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57743 - RNA, 1758 nt, Artificial Sequence
  hemagglutinin__InfluenzaB__AGX18589
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaccgagacccaaauggcaaagcucuauggggacucaaagccccagaaguucaccucaucugccaacggagugaccacacauuacguuucacagauuggugacuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaaaguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuuguuccaucugucuauaa

SEQ ID NO: 57744 - RNA, 1758 nt, Artificial Sequence
  hemagglutinin__InfluenzaB__AGX18600
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggcuuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57745 - RNA, 1758 nt, Artificial Sequence; identical to SEQ ID NO: 57738
  hemagglutinin__InfluenzaB__AGX18611

SEQ ID NO: 57746 - RNA, 1758 nt, Artificial Sequence
  hemagglutinin__InfluenzaB__AGX18622
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57747 - RNA, 1758 nt, Artificial Sequence; identical to SEQ ID NO: 57740
  hemagglutinin__InfluenzaB__AGX18633

SEQ ID NO: 57748 - RNA, 1758 nt, Artificial Sequence; identical to SEQ ID NO: 57740
  hemagglutinin__InfluenzaB__AGX18644

SEQ ID NO: 57749 - RNA, 1758 nt, Artificial Sequence; identical to SEQ ID NO: 57740
  hemagglutinin__InfluenzaB__AGX18655

SEQ ID NO: 57750 - RNA, 1758 nt, Artificial Sequence; identical to SEQ ID NO: 57740
  hemagglutinin__InfluenzaB__AGX18666

SEQ ID NO: 57751 - RNA, 1758 nt, Artificial Sequence; identical to SEQ ID NO: 57738
  hemagglutinin__InfluenzaB__AGX18677

SEQ ID NO: 57752 - RNA, 1758 nt, Artificial Sequence; identical to SEQ ID NO: 57740
  hemagglutinin__InfluenzaB__AGX18688

SEQ ID NO: 57753 - RNA, 1758 nt, Artificial Sequence
  hemagglutinin__InfluenzaB__AGX18699
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauugacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugagaccaaacacaaaugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57754 - RNA, 1758 nt, Artificial Sequence; identical to SEQ ID NO: 57738
  hemagglutinin__InfluenzaB__AGX18710

SEQ ID NO: 57755 - RNA, 1758 nt, Artificial Sequence; identical to SEQ ID NO: 57738
  hemagglutinin__InfluenzaB__AGX18721

SEQ ID NO: 57756 - RNA, 1758 nt, Artificial Sequence; identical to SEQ ID NO: 57740
  hemagglutinin__InfluenzaB__AGX18732

SEQ ID NO: 57757 - RNA, 1758 nt, Artificial Sequence
  hemagglutinin__InfluenzaB__AGX18743
augaaggcaauaauuguacuacucaugguaguaacauccaaugcagaucgaaucugcacugggauaacaucgucaaacucaccacauguugucaaaacugcuacucaaggggaggucaaugugacugguguaauaccacuaacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaaaucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuagccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaccucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57758 - RNA, 1758 nt, Artificial Sequence; identical to SEQ ID NO: 57740
  hemagglutinin__InfluenzaB__AGX18754

SEQ ID NO: 57759 - RNA, 1758 nt, Artificial Sequence; identical to SEQ ID NO: 57738
  hemagglutinin__InfluenzaB__AGX18765

SEQ ID NO: 57760 - RNA, 1758 nt, Artificial Sequence
  hemagglutinin__InfluenzaB__AGX18776
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaaugacaacaacaaaacagcaacaaauucauugacaauagaaguaccauacauuuguacagaaggagaagaccaaauuaccguuuggggguuccacucugauaacgaaauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugagaccaaacacaaaugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57761 - RNA, 1758 nt, Artificial Sequence
  hemagglutinin__InfluenzaB__AGX18787
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagaggcauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacauaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57762 - RNA, 1758 nt, Artificial Sequence; identical to SEQ ID NO: 57740
  hemagglutinin__InfluenzaB__AGX18798

SEQ ID NO: 57763 - RNA, 1758 nt, Artificial Sequence
  hemagglutinin__InfluenzaB__AGX18809
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauugacaauagaaguaccauacauuuguacagaaggagaagaccaaauuaccguuuggggguuccacucugauagcgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugaugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugagaccaaacacaaaugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57764 - RNA, 1758 nt, Artificial Sequence
  hemagglutinin__InfluenzaB__AGX18820
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauugacaauagaaguaccauacauuuguacagaaggagaagaccaaauuaccguuuggggguuccacucugauaacgaaaaccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugagaccaaacacaaaugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57765 - RNA, 1758 nt, Artificial Sequence
  hemagglutinin__InfluenzaB__AGX18831
augaaggcaauaauuguacuacucaugguaguaacauccaaugcagaucgaaucugcacugggauaacaucgucaaacucaccacauguugucaaaacugcuacucaaggggaggucaaugugaccgguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57766 - RNA, 1758 nt, Artificial Sequence
  hemagglutinin__InfluenzaB__AGX18842
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuagccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaccucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57767 - RNA, 1758 nt, Artificial Sequence
  hemagglutinin__InfluenzaB__AGX18853
augaaggcaauaauuguacuacucaugguaguaacauccaaugcagaucgaaucugcacugggauaacaucgucaaacucaccacauguugucaaaacugccacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaggcccaaauggcaaagcucuauggggauucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57768 - RNA, 1758 nt, Artificial Sequence
  hemagglutinin__InfluenzaB__AGX18864
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucuuauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaaaucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaggcccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuagccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaccucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57769 - RNA, 1758 nt, Artificial Sequence
  hemagglutinin__InfluenzaB__AGX18875
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauagaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuagccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauagaugaacuccacaacgaaauacuagaacuagacgagaaaguggaugaucucagagcugauacaauaagcucacaaauagaacucgcaguccugcuuuccaaugaaggaauaauaaacagugaagaugagcaccucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57770 - RNA, 1758 nt, Artificial Sequence
  hemagglutinin__InfluenzaB__AGX18886
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaauguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauugacaauagaaguaccauacauuuguacagaaggagaagaccaaauuaccguuuggggguuccacucugauaacgaaauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugagaccaaacacaaaugcaaccagaccugucucgacagaauagcugcugguaccuuugaugcaggagaauuuucucuccccacuuuugauucacugaauauuacugcugcaucuuuaaaugacaauggauuggauaaucauacuauacugcuuuacuacucaacugcugccuccaguuuggcuguaacauugauaauagcuaucuuuguuguuuauauggucuccagagacaauguuucuugcuccaucugucuauaa

SEQ ID NO: 57771 - RNA, 1758 nt, Artificial Sequence
  hemagglutinin__InfluenzaB__AGX18897
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacacacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggaguaaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggggaauuuucucuccccaccuuugauucacuaaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57772 - RNA, 1758 nt, Artificial Sequence; identical to SEQ ID NO: 57738
  hemagglutinin__InfluenzaB__AGX18908

SEQ ID NO: 57773 - RNA, 1758 nt, Artificial Sequence
  hemagglutinin__InfluenzaB__AGX18919
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57774 - RNA, 1758 nt, Artificial Sequence
  hemagglutinin__InfluenzaB__AGX18930
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuauacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccuguaucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57775 - RNA, 1758 nt, Artificial Sequence
  hemagglutinin__InfluenzaB__AGX18941
augaaggcaauaauuguacuacucaugguaguaacauccaaugcagaucgaaucugcacugggauaacaucgucaaacucaccacauguugucaaaacugcuacucaaggggaagucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaaucagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcuaggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57776 - RNA, 1758 nt, Artificial Sequence; identical to SEQ ID NO: 57740
  hemagglutinin__InfluenzaB__AGX18952

SEQ ID NO: 57777 - RNA, 1758 nt, Artificial Sequence; identical to SEQ ID NO: 57765
  hemagglutinin__InfluenzaB__AGX18963

SEQ ID NO: 57778 - RNA, 1758 nt, Artificial Sequence
  hemagglutinin__InfluenzaB__AGX18974
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauugacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccccaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaaaaaagcugaagaaaaugcugggccccucugcuguagagauagggaauggaugcuuugagaccaaacacaaaugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57779 - RNA, 1758 nt, Artificial Sequence
  hemagglutinin__InfluenzaB__AGX18985
augaaggcaauaauuguacuacucaugguaguaacauccaaugcagaucgaaucugcacugggauaacaucgucaaacucaccacauguugucaaaacugcuacucaaggggaagucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaaucagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57780 - RNA, 1758 nt, Artificial Sequence
  hemagglutinin__InfluenzaB__AGX18996
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacacacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacggaacccaaauggcaaagcucuauggggacucaaagccccagaaguucaccucaucugccaacggaguaaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggggaauuuucucuccccaccuuugauucacuaaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57781 - RNA, 1758 nt, Artificial Sequence; identical to SEQ ID NO: 57738
  hemagglutinin__InfluenzaB__AGX19007

SEQ ID NO: 57782 - RNA, 1758 nt, Artificial Sequence
  hemagglutinin__InfluenzaB__AGX19018
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaacuuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauagcgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57783 - RNA, 1758 nt, Artificial Sequence; identical to SEQ ID NO: 57764
  hemagglutinin__InfluenzaB__AGX19029

SEQ ID NO: 57784 - RNA, 1758 nt, Artificial Sequence
  hemagglutinin__InfluenzaB__AGX19040
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaccucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaaucagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57785 - RNA, 1758 nt, Artificial Sequence
  hemagglutinin__InfluenzaB__AGX19051
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaauacagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauagcgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57786 - RNA, 1758 nt, Artificial Sequence
  hemagglutinin__InfluenzaB__AGX19062
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauucgacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaauuucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57787 - RNA, 1758 nt, Artificial Sequence
  hemagglutinin__InfluenzaB__AGX19073
augaaggcaauaauuguacuacucaugguaguaacauccaaugcagaucgaaucugcacugggauaacaucgucaaacucaccacauguugucaaaacugcuacucaaggggaggucaaugugaccgguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaagugccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57788 - RNA, 1758 nt, Artificial Sequence
  hemagglutinin__InfluenzaB__AGX19084
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucaaguuaucaacucauaacguuaucaaugcagaaaaugcaccaggaggacccuacaaaauuggaaccucagggucuugcccuaacguuaccaauggaaacggauuuuucgcaacaauggcuugggccguuccaaaaaacgacaacaacaaaacagcaacaaauucauuaacgauagaaguaccauacauuuguacagaaggagaagaccaaauuaccguuuggggguuccacucugauaacgagaaccaaauggcaaagcucuauggggacucaaagccccagaaguucaccucaucugccaacggagugaccacacauuacguuucacagauugguggcuucccaaaucaaacagaagacggaggauuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucagagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucccuccccaccuuugauucacugaauauuacugcugcaucuuuaaaugacgauggauuggauaaucauacuauacugcuuuacuacucaacugcugccuccaguuuggcgguaacauugaugauagcuaucuuuguuguuuauauggucuccagagacaauguuucuugcuccaucugucuauaa

SEQ ID NO: 57789 - RNA, 1758 nt, Artificial Sequence; identical to SEQ ID NO: 57738
  hemagglutinin__InfluenzaB__AGX19095

SEQ ID NO: 57790 - RNA, 1758 nt, Artificial Sequence; identical to SEQ ID NO: 57764
  hemagglutinin__InfluenzaB__AGX19106

SEQ ID NO: 57791 - RNA, 1758 nt, Artificial Sequence
  hemagglutinin__InfluenzaB__AGX19117
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccgggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaagaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57792 - RNA, 1758 nt, Artificial Sequence
  hemagglutinin__InfluenzaB__AGX19128
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacagggaacacacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauagcgaaacccaaauggcaaagcucuauggggacucaaagccccagaaguucaccucaucugccaacggaguaaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugugcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggggaauuuucucuccccaccuuugauucacuaaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57793 - RNA, 1758 nt, Artificial Sequence
  hemagglutinin__InfluenzaB__AGX19139
augaaggcaauaauuguacuacucaugguaguaacauccaaugcagaucgaaucugcacugggauaacaucgucaaacucaccacauguugucaaaacugcuacucaaggggaagucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaaucagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacaugguacaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcuaggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57794 - RNA, 1758 nt, Artificial Sequence; identical to SEQ ID NO: 57771
  hemagglutinin__InfluenzaB__AGX19150

SEQ ID NO: 57795 - RNA, 1758 nt, Artificial Sequence; identical to SEQ ID NO: 57740
  hemagglutinin__InfluenzaB__AGX19161

SEQ ID NO: 57796 - RNA, 1758 nt, Artificial Sequence
  hemagglutinin__InfluenzaB__AGX19172
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacacacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggaguaaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcuaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggggaauuuucucuccccaccuuugauucacuaaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57797 - RNA, 1758 nt, Artificial Sequence
  hemagglutinin__InfluenzaB__AGX19183
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacgacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaccgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagaggcauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57798 - RNA, 1758 nt, Artificial Sequence; identical to SEQ ID NO: 57738
  hemagglutinin__InfluenzaB__AGX19194

SEQ ID NO: 57799 - RNA, 1758 nt, Artificial Sequence
  hemagglutinin__InfluenzaB__AGX19205
augaaggcaauaauuguacuacucaugguaguaacauccaaugcagaucgagucugcacugggauaacaucgucaaacucaccacauguugucaaaacugcuacucaaggggaagucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaaucagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57800 - RNA, 1758 nt, Artificial Sequence
  hemagglutinin__InfluenzaB__AGX19216
augaaggcaauaauuguacuacucaugguaguaacauccaaugcagaucgaaucugcacugggauaacaucgucaaacucaccacauguugucaaaacugcuacucaaggggagguuaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaccaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauauacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugagggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57801 - RNA, 1758 nt, Artificial Sequence
  hemagglutinin__InfluenzaB__AGX19227
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccacaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaagcgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaagguggaugaucucagagcugauacaauaagcucacaaauagaacucgcaguccugcucuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57802 - RNA, 1758 nt, Artificial Sequence
  hemagglutinin__InfluenzaB__AGX19238
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucagcaagaguuucaauacuccaugaagucagaccuguuacaucugggugcuuuccuauaaugcacgacagaacaaaaauuagacagcugccuaaccuucucagaggauacgaacauaucagguuaucaacucauaacgucaucaaugcagaaaaugcaccaggaggacccuacaaaauuggaaccucagggucuugcccuaacguuaccaauggaaacggauuuuuugcaacaauggcuugggccgucccaaagaacgacaaaaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuagaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57803 - RNA, 1758 nt, Artificial Sequence; identical to SEQ ID NO: 57802
  hemagglutinin__InfluenzaB__AGX19249

SEQ ID NO: 57804 - RNA, 1758 nt, Artificial Sequence; identical to SEQ ID NO: 57765
  hemagglutinin__InfluenzaB__AGX19260

SEQ ID NO: 57805 - RNA, 1758 nt, Artificial Sequence
  hemagglutinin__InfluenzaB__AGX19271
augaaggcaauaauuguacuacucaugguaguaacaucaaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguacuuuugaugcaggagaauuuucucuccccaccuuugauucacugaauauuacugcugcaucuuuaaaugacgauggauuggauaaucauacuauacugcuuuacuacucaacugcugccuccaguuuggcuguaacauuaaugauagcuaucuuuguuguuuauauggucuccagagacaauguuucuugcuccaucugucuauaa

SEQ ID NO: 57806 - RNA, 1758 nt, Artificial Sequence
  hemagglutinin__InfluenzaB__AGX19282
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcacaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57807 - RNA, 1758 nt, Artificial Sequence
  hemagglutinin__InfluenzaB__AGX19304
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaauaaauucauuaacaauagaaguaccauacauuuguacagagggagaagaccaaauuaccguuuggggauuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57808 - RNA, 1758 nt, Artificial Sequence; identical to SEQ ID NO: 57807
  hemagglutinin__InfluenzaB__AGX19315

SEQ ID NO: 57809 - RNA, 1758 nt, Artificial Sequence
  hemagglutinin__InfluenzaB__AGX19326
augaaggcaauaauuguacuacucaugguaguaacauccaaugcagaucgaaucugcacugggauaacaucgucaaacucaccacauguugucaaaacugcuacccaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcacaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57810 - RNA, 1758 nt, Artificial Sequence; identical to SEQ ID NO: 57806
  hemagglutinin__InfluenzaB__AGX19337

SEQ ID NO: 57811 - RNA, 1758 nt, Artificial Sequence
  hemagglutinin__InfluenzaB__AGX19348
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaagcccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcacaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57812 - RNA, 1758 nt, Artificial Sequence
  hemagglutinin__InfluenzaB__AGX19359
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcacaaguggcaggagcaagguaauaaaaggauccuugccuuuaauuggagaagcagauugccuccacgaaaaauacgguggauuaaacaaaagcaagccuuacuauacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57813 - RNA, 1755 nt, Artificial Sequence; identical to SEQ ID NO: 57548
  hemagglutinin__InfluenzaB__AGX19370

SEQ ID NO: 57814 - RNA, 1758 nt, Artificial Sequence
  hemagglutinin__InfluenzaB__AGX19381
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcuaggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57815 - RNA, 1758 nt, Artificial Sequence
  hemagglutinin__InfluenzaB__AGX19392
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcacaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57816 - RNA, 1758 nt, Artificial Sequence; identical to SEQ ID NO: 57806
  hemagglutinin__InfluenzaB__AGX19403

SEQ ID NO: 57817 - RNA, 1758 nt, Artificial Sequence
  hemagglutinin__InfluenzaB__AGX19414
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57818 - RNA, 1755 nt, Artificial Sequence
  hemagglutinin__InfluenzaB__AGX19425
augaagacaauaauuguacuacucaugguaguaacauccaaugcagaucgaaucugcacuggaauaacauccucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaggaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaggguguggugcgcgaguggcaggagcaaaguaauaaaaggggccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57819 - RNA, 1758 nt, Artificial Sequence; identical to SEQ ID NO: 57499
  hemagglutinin__InfluenzaB__AGX19436

SEQ ID NO: 57820 - RNA, 1758 nt, Artificial Sequence
  hemagglutinin__InfluenzaB__AGX19447
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaaaccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57821 - RNA, 1755 nt, Artificial Sequence
  hemagglutinin__InfluenzaB__AGX19458
augaaggcaauaauuguacuacucaugguaguaacauccaaugcagaucgaaucugcacuggaauaacauccucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaggguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57822 - RNA, 1755 nt, Artificial Sequence
  hemagglutinin__InfluenzaB__AGX19469
augaaggcaauaauuguacuacucaugguaguaacauccaaugcagaucgaaucugcacuggaauaacauccucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaggguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuuuuucggagcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 57823 - RNA, 1758 nt, Artificial Sequence; identical to SEQ ID NO: 57495
  hemagglutinin__InfluenzaB__AGX19480

SEQ ID NO: 57824 - RNA, 1758 nt, Artificial Sequence
  hemagglutinin__InfluenzaB__AGX19491
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaagcccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57825 - RNA, 1758 nt, Artificial Sequence
  hemagglutinin__InfluenzaB__AGX19502
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacagcgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57826 - RNA, 1758 nt, Artificial Sequence
  hemagglutinin__InfluenzaB__AGX19513
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacauuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57827 - RNA, 1758 nt, Artificial Sequence; identical to SEQ ID NO: 57826
  hemagglutinin__InfluenzaB__AGX19524

SEQ ID NO: 57828 - RNA, 1758 nt, Artificial Sequence
  hemagglutinin__InfluenzaB__AGX19535
augaaggcaauaauuguacuacucaugguaguaacauccaaugcagauagaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugaugacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57829 - RNA, 1758 nt, Artificial Sequence
  hemagglutinin__InfluenzaB__AGX19546
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaaagaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57830 - RNA, 1758 nt, Artificial Sequence
  hemagglutinin__InfluenzaB__AGX19557
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagaggaaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagggggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57831 - RNA, 1758 nt, Artificial Sequence
  hemagglutinin__InfluenzaB__AGX19568
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucuggguguuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57832 - RNA, 1758 nt, Artificial Sequence; identical to SEQ ID NO: 57826
  hemagglutinin__InfluenzaB__AGX19579

SEQ ID NO: 57833 - RNA, 1758 nt, Artificial Sequence; identical to SEQ ID NO: 57493
  hemagglutinin__InfluenzaB__AGX19590

SEQ ID NO: 57834 - RNA, 1758 nt, Artificial Sequence
  hemagglutinin__InfluenzaB__AGX19601
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacccauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57835 - RNA, 1758 nt, Artificial Sequence; identical to SEQ ID NO: 57495
  hemagglutinin__InfluenzaB__AGX19612

SEQ ID NO: 57836 - RNA, 1758 nt, Artificial Sequence
  hemagglutinin__InfluenzaB__AGX19623
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguagcauugaugauagcuaucuuuguuguuuauauggucuccagagacaauguuucuugcuccaucugucuauaa

SEQ ID NO: 57837 - RNA, 1758 nt, Artificial Sequence; identical to SEQ ID NO: 57494
  hemagglutinin__InfluenzaB__AGX19634

SEQ ID NO: 57838 - RNA, 1758 nt, Artificial Sequence; identical to SEQ ID NO: 57499
  hemagglutinin__InfluenzaB__AGX19645

SEQ ID NO: 57839 - RNA, 1758 nt, Artificial Sequence
  hemagglutinin__InfluenzaB__AGX19656
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57840 - RNA, 1758 nt, Artificial Sequence
  hemagglutinin__InfluenzaB__AGX19667
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaaggaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57841 - RNA, 1758 nt, Artificial Sequence; identical to SEQ ID NO: 57501
  hemagglutinin__InfluenzaB__AGX19678

SEQ ID NO: 57842 - RNA, 1758 nt, Artificial Sequence
  hemagglutinin__InfluenzaB__AGX19700
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugcuuccaguuuggcuguaacauugaugauagcuaucuuuguuguuuauauggucuccagagacaauguuucuugcuccaucugucuauaa

SEQ ID NO: 57843 - RNA, 1758 nt, Artificial Sequence
  hemagglutinin__InfluenzaB__AGX19711
augaaggcaauaauuguacuacucaugguaguaacauccaaugcagaucgaaucugcacugggauaacaucgucaaacucaccacauguugucaaaacugcuacucaaggggaggucaaugugacuggcguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaauguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauucauuaacaauagaaguaccauacauuuguaaagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcugcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57844 - RNA, 1758 nt, Artificial Sequence
  hemagglutinin__InfluenzaB__AGX19722
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuacuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57845 - RNA, 1758 nt, Artificial Sequence; identical to SEQ ID NO: 57493
  hemagglutinin__InfluenzaB__AGX19733

SEQ ID NO: 57846 - RNA, 1758 nt, Artificial Sequence
  hemagglutinin__InfluenzaB__AGX19744
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcaauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcuaaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57847 - RNA, 1758 nt, Artificial Sequence; identical to SEQ ID NO: 57499
  hemagglutinin__InfluenzaB__AGX19755

SEQ ID NO: 57848 - RNA, 1758 nt, Artificial Sequence; identical to SEQ ID NO: 57495
  hemagglutinin__InfluenzaB__AGX19766

SEQ ID NO: 57849 - RNA, 1758 nt, Artificial Sequence; identical to SEQ ID NO: 57826
  hemagglutinin__InfluenzaB__AGX19788

SEQ ID NO: 57850 - RNA, 1758 nt, Artificial Sequence; identical to SEQ ID NO: 57495
  hemagglutinin__InfluenzaB__AGX19799

SEQ ID NO: 57851 - RNA, 1758 nt, Artificial Sequence; identical to SEQ ID NO: 57493
  hemagglutinin__InfluenzaB__AGX19810

SEQ ID NO: 57852 - RNA, 1758 nt, Artificial Sequence
  hemagglutinin__InfluenzaB__AGX19821
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaaaaaucuucaaagacuaagcgguuccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57853 - RNA, 1758 nt, Artificial Sequence
  hemagglutinin__InfluenzaB__AGX19832
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacauuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaagggaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57854 - RNA, 1758 nt, Artificial Sequence; identical to SEQ ID NO: 57501
  hemagglutinin__InfluenzaB__AGX19843

SEQ ID NO: 57855 - RNA, 1758 nt, Artificial Sequence; identical to SEQ ID NO: 57500
  hemagglutinin__InfluenzaB__AGX19854

SEQ ID NO: 57856 - RNA, 1758 nt, Artificial Sequence; identical to SEQ ID NO: 57495
  hemagglutinin__InfluenzaB__AGX19865

SEQ ID NO: 57857 - RNA, 1758 nt, Artificial Sequence; identical to SEQ ID NO: 57826
  hemagglutinin__InfluenzaB__AGX19876

SEQ ID NO: 57858 - RNA, 1758 nt, Artificial Sequence; identical to SEQ ID NO: 57494
  hemagglutinin__InfluenzaB__AGX19887

SEQ ID NO: 57859 - RNA, 1758 nt, Artificial Sequence
  hemagglutinin__InfluenzaB__AGX19898
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaaugaaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57860 - RNA, 1758 nt, Artificial Sequence
  hemagglutinin__InfluenzaB__AGX19909
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguaguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57861 - RNA, 1758 nt, Artificial Sequence; identical to SEQ ID NO: 57494
  hemagglutinin__InfluenzaB__AGX19920

SEQ ID NO: 57862 - RNA, 1758 nt, Artificial Sequence; identical to SEQ ID NO: 57859
  hemagglutinin__InfluenzaB__AGX19931

SEQ ID NO: 57863 - RNA, 1758 nt, Artificial Sequence; identical to SEQ ID NO: 57826
  hemagglutinin__InfluenzaB__AGX19942

SEQ ID NO: 57864 - RNA, 1758 nt, Artificial Sequence; identical to SEQ ID NO: 57493
  hemagglutinin__InfluenzaB__AGX19953

SEQ ID NO: 57865 - RNA, 1758 nt, Artificial Sequence
  hemagglutinin__InfluenzaB__AGX19964
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucuggguguuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagauccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57866 - RNA, 1758 nt, Artificial Sequence
  hemagglutinin__InfluenzaB__AGX19975
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuggaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57867 - RNA, 1758 nt, Artificial Sequence
  hemagglutinin__InfluenzaB__AGX19986
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcguaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuggaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57868 - RNA, 1758 nt, Artificial Sequence
  hemagglutinin__InfluenzaB__AGX19997
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaauagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcaauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57869 - RNA, 1758 nt, Artificial Sequence; identical to SEQ ID NO: 57495
  hemagglutinin__InfluenzaB__AGX20008

SEQ ID NO: 57870 - RNA, 1758 nt, Artificial Sequence; identical to SEQ ID NO: 57493
  hemagglutinin__InfluenzaB__AGX20019

SEQ ID NO: 57871 - RNA, 1758 nt, Artificial Sequence; identical to SEQ ID NO: 57817
  hemagglutinin__InfluenzaB__AGX20030

SEQ ID NO: 57872 - RNA, 1758 nt, Artificial Sequence
  hemagglutinin__InfluenzaB__AGX20041
augaaggcaauaauuguacuacucaugguaguaacauccgaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaaaagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcaauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaacauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57873 - RNA, 1758 nt, Artificial Sequence
  hemagglutinin__InfluenzaB__AGX20052
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucuauuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57874 - RNA, 1758 nt, Artificial Sequence; identical to SEQ ID NO: 57873
  hemagglutinin__InfluenzaB__AGX20063

SEQ ID NO: 57875 - RNA, 1758 nt, Artificial Sequence
  hemagglutinin__InfluenzaB__AGX20074
augaaggcaauaauugcacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacgggggacuaccacaaagugguagaauuguuguugauuacauggugcaaaaaucugggaaaacaggaacaauuaccuaucaaagggguauuuuauugccucaaaagguguggugcgcaaguggcaggaguaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57876 - RNA, 1758 nt, Artificial Sequence
  hemagglutinin__InfluenzaB__AGX20085
augaaggcaauaauuguacuacucaugguaguaacauccaaugcagaucgaaucugcacugggauaacaucgucaaacucaccacaugucgucaaaacugcuacucaaggggaggucaaugugacugguguaauaccacuaacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccauuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcaauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57877 - RNA, 1758 nt, Artificial Sequence
  hemagglutinin__InfluenzaB__AGX20096
augaaggcaauaauuguacuacucaugguaguaacauccaaugcagaccgaaucugcacugggguaacaucgucaaacucaccacauguugucaaaacugcuacucaaggggaggucaaugugacugguguaauaccacugacaacaacacccaccaaaucucauuuugcaaaucucaaaggaacagaaaccagaggaaaacuaugcccaaaaugccuaaacugcacagaucuggacguggccuugggcagaccaaaaugcacgggaaacauacccucagcaagaguuucaauacuccaugaagucagaccuguuacaucugggugcuuuccuauaaugcacgacagaacaaaaauuagacaacugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaccaaacagaagacggagggcuaccacaaagugguagaauuguuguugauuacauggugcaaaaaucugggaaaacaggaacaaucaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucucauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguucugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 57878 - RNA, 1758 nt, Artificial Sequence; identical to SEQ ID NO: 57507
  hemagglutinin__InfluenzaB__AGX20107

SEQ ID NO: 57879 - RNA, 1758 nt, Artificial Sequence
  hemagglutinin__InfluenzaB__AGX20118
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagagguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaaaaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57880 - RNA, 1758 nt, Artificial Sequence
  hemagglutinin__InfluenzaB__AGX20129
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagaggaaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57881 - RNA, 1758 nt, Artificial Sequence; identical to SEQ ID NO: 57146
  hemagglutinin__InfluenzaB__AGX20140

SEQ ID NO: 57882 - RNA, 1758 nt, Artificial Sequence
  hemagglutinin__InfluenzaB__AGX20151
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucuggaugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57883 - RNA, 1758 nt, Artificial Sequence; identical to SEQ ID NO: 57146
  hemagglutinin__InfluenzaB__AGX20162

SEQ ID NO: 57884 - RNA, 1758 nt, Artificial Sequence
  hemagglutinin__InfluenzaB__AGX20173
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuucacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57885 - RNA, 1758 nt, Artificial Sequence; identical to SEQ ID NO: 57144
  hemagglutinin__InfluenzaB__AGX20184

SEQ ID NO: 57886 - RNA, 1758 nt, Artificial Sequence
  hemagglutinin__InfluenzaB__AGX20195
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacgcauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaucagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57887 - RNA, 1758 nt, Artificial Sequence
  hemagglutinin__InfluenzaB__AGX20206
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuggaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57888 - RNA, 1758 nt, Artificial Sequence; identical to SEQ ID NO: 57146
  hemagglutinin__InfluenzaB__AGX20217

SEQ ID NO: 57889 - RNA, 1758 nt, Artificial Sequence
  hemagglutinin__InfluenzaB__AGX20228
augaaggcaauaauuguacuacuaaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggauguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaaaccccagaaguucaccucaucugccaacggagugaccacacauuacguuucacagauuggugguuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuauuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacuugcaguccugcuuuccaaugaaggaauaauaaacagugaagaugaacaucucuuggcgcucgaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57890 - RNA, 1758 nt, Artificial Sequence
  hemagglutinin__InfluenzaB__AGX20239
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaucguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57891 - RNA, 1758 nt, Artificial Sequence; identical to SEQ ID NO: 57882
  hemagglutinin__InfluenzaB__AGX20250

SEQ ID NO: 57892 - RNA, 1758 nt, Artificial Sequence; identical to SEQ ID NO: 57143
  hemagglutinin__InfluenzaB__AGX20261

SEQ ID NO: 57893 - RNA, 1758 nt, Artificial Sequence; identical to SEQ ID NO: 57146
  hemagglutinin__InfluenzaB__AGX20272

SEQ ID NO: 57894 - RNA, 1758 nt, Artificial Sequence
  hemagglutinin__InfluenzaB__AGX20283
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57895 - RNA, 1758 nt, Artificial Sequence
  hemagglutinin__InfluenzaB__AGX20294
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggguacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57896 - RNA, 1758 nt, Artificial Sequence
  hemagglutinin__InfluenzaB__AGX20305
augaaggcaauaauuguacuacucaugguaguaacauccaaugcagaucgaaucugcacugggauaacaucgucaaacucaccacaugucgucaaaacugcuacucaaggggaggucaauguaacuggugugauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaucuucuccgaggauacgaacauaucagguuaucaacucauaacguuaucaaugcagaaaaugcaccaggaggacccuacaaaauuggaaccucagggucuugcccuaauguuaccaauggaaacggauuuuucgcaacaauggcuugggccgucccaaagaacgacaaaaacaaaacagcaacaaaucaauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauugaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugaugauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57897 - RNA, 1758 nt, Artificial Sequence; identical to SEQ ID NO: 57143
  hemagglutinin__InfluenzaB__AGX20316

SEQ ID NO: 57898 - RNA, 1758 nt, Artificial Sequence; identical to SEQ ID NO: 57144
  hemagglutinin__InfluenzaB__AGX20327

SEQ ID NO: 57899 - RNA, 1758 nt, Artificial Sequence
  hemagglutinin__InfluenzaB__AGX20338
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugcccuaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaauguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaaccucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaaaguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57900 - RNA, 1758 nt, Artificial Sequence
  hemagglutinin__InfluenzaB__AGX20349
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaagggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57901 - RNA, 1758 nt, Artificial Sequence; identical to SEQ ID NO: 57887
  hemagglutinin__InfluenzaB__AGX20360

SEQ ID NO: 57902 - RNA, 1758 nt, Artificial Sequence; identical to SEQ ID NO: 57163
  hemagglutinin__InfluenzaB__AGX20371

SEQ ID NO: 57903 - RNA, 1758 nt, Artificial Sequence
  hemagglutinin__InfluenzaB__AGX20382
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccaugaaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57904 - RNA, 1758 nt, Artificial Sequence; identical to SEQ ID NO: 57894
  hemagglutinin__InfluenzaB__AGX20393

SEQ ID NO: 57905 - RNA, 1758 nt, Artificial Sequence; identical to SEQ ID NO: 57163
  hemagglutinin__InfluenzaB__AGX20404

SEQ ID NO: 57906 - RNA, 1758 nt, Artificial Sequence; identical to SEQ ID NO: 57143
  hemagglutinin__InfluenzaB__AGX20415

SEQ ID NO: 57907 - RNA, 1758 nt, Artificial Sequence; identical to SEQ ID NO: 57147
  hemagglutinin__InfluenzaB__AGX20426

SEQ ID NO: 57908 - RNA, 1758 nt, Artificial Sequence; identical to SEQ ID NO: 57143
  hemagglutinin__InfluenzaB__AGX20437

SEQ ID NO: 57909 - RNA, 1758 nt, Artificial Sequence
  hemagglutinin__InfluenzaB__AGX20448
augaaagcaauaauuguacuacucaugguaguaacauccaaugcagaucgaaucugcacugggauaacaucgucaaacucaccacaugucgucaaaacugccacucaaggggaggucaaugugacugguguaauaccacugacaacaacacccaccaaaucucauuuugcaaaucucaaaggaacagaaaccagagggaaacuaugcccaaaaugccccaacugcacagaucuggacguagcccugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaacuucagggucuugcccuaauguuaccaauggaaacggauuuuucgcaacaauggcuugggcugucccaaaaaacgacaaaaacaaaacagcaacaaacccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57910 - RNA, 1758 nt, Artificial Sequence; identical to SEQ ID NO: 57144
  hemagglutinin__InfluenzaB__AGX20459

SEQ ID NO: 57911 - RNA, 1758 nt, Artificial Sequence; identical to SEQ ID NO: 57887
  hemagglutinin__InfluenzaB__AGX20470

SEQ ID NO: 57912 - RNA, 1758 nt, Artificial Sequence
  hemagglutinin__InfluenzaB__AGX20481
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagggacaauguuucuugcuccaucugucuauaa

SEQ ID NO: 57913 - RNA, 1758 nt, Artificial Sequence
  hemagglutinin__InfluenzaB__AGX20492
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaacugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57914 - RNA, 1758 nt, Artificial Sequence
  hemagglutinin__InfluenzaB__AGX20503
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggagacucaaagccccagaaguucaccucaucugccaacggagugaccacacauuacguuucacagauugguggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57915 - RNA, 1758 nt, Artificial Sequence; identical to SEQ ID NO: 57144
  hemagglutinin__InfluenzaB__AGX20514

SEQ ID NO: 57916 - RNA, 1758 nt, Artificial Sequence
  hemagglutinin__InfluenzaB__AGX20525
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuuucaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauugcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57917 - RNA, 1758 nt, Artificial Sequence; identical to SEQ ID NO: 57515
  hemagglutinin__InfluenzaB__AGX20536

SEQ ID NO: 57918 - RNA, 1758 nt, Artificial Sequence
  hemagglutinin__InfluenzaB__AGX20547
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacaucacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaauaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguacuuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57919 - RNA, 1758 nt, Artificial Sequence; identical to SEQ ID NO: 57166
  hemagglutinin__InfluenzaB__AGX20558

SEQ ID NO: 57920 - RNA, 1758 nt, Artificial Sequence; identical to SEQ ID NO: 57887
  hemagglutinin__InfluenzaB__AGX20569

SEQ ID NO: 57921 - RNA, 1758 nt, Artificial Sequence
  hemagglutinin__InfluenzaB__AGX20580
augaaggcaauaauuguacuacucaugguaguaacauccaaugcagaucgaaucugcacugggauaacaucgucaaacucaccacaugucgucaaaacugcuacucaaggggaggucaaugucacugguguaauaccacugacaacaacacccaccaaaucucacuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguggcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57922 - RNA, 1758 nt, Artificial Sequence; identical to SEQ ID NO: 57144
  hemagglutinin__InfluenzaB__AGX20591

SEQ ID NO: 57923 - RNA, 1758 nt, Artificial Sequence; identical to SEQ ID NO: 57515
  hemagglutinin__InfluenzaB__AGX20602

SEQ ID NO: 57924 - RNA, 1758 nt, Artificial Sequence
  hemagglutinin__InfluenzaB__AGX20613
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacacaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57925 - RNA, 1758 nt, Artificial Sequence
  hemagglutinin__InfluenzaB__AGX20624
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggauguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaaugagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagagguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaaaaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57926 - RNA, 1758 nt, Artificial Sequence
  hemagglutinin__InfluenzaB__AGX20635
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccuaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggagaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57927 - RNA, 1758 nt, Artificial Sequence
  hemagglutinin__InfluenzaB__AGX20646
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugcuauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57928 - RNA, 1758 nt, Artificial Sequence
  hemagglutinin__InfluenzaB__AGX20668
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaccaaaacagcaacaaauccauuaacaauagaaguaccauacaucuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcagaagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucuugacagaauagcugcugguaccuuugaugcaggagaauuuucucuccccaccuuugauucacugaauauuacugcugcgucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57929 - RNA, 1758 nt, Artificial Sequence
  hemagglutinin__InfluenzaB__AGX20679
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugccccaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57930 - RNA, 1758 nt, Artificial Sequence
  hemagglutinin__InfluenzaB__AGX20690
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaaccgaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggcugucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuccaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57931 - RNA, 1758 nt, Artificial Sequence
  hemagglutinin__InfluenzaB__AGX20701
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugcccaaccuucuccgaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguacuuuugaugcaggagaauuuucucuccccaccuuugauucacugaauauuacugcugcgucuuuaaaugacgauggauuagauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57932 - RNA, 1758 nt, Artificial Sequence
  hemagglutinin__InfluenzaB__AGX20712
augaaggcaauaauuguacuacucaugguaguaacauccaaugcagaucgaaucugcacugggauaacgucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucuauuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57933 - RNA, 1758 nt, Artificial Sequence
  hemagglutinin__InfluenzaB__AGX20723
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacaucuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcagaagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcgucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57934 - RNA, 1758 nt, Artificial Sequence
  hemagglutinin__InfluenzaB__AGX20734
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacuaauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuccaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57935 - RNA, 1758 nt, Artificial Sequence
  hemagglutinin__InfluenzaB__AGX20745
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccauuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57936 - RNA, 1758 nt, Artificial Sequence
  hemagglutinin__InfluenzaB__AGX20756
augaaggcaauaauuguacuacucaugguaguaacauccaaugcagaucgaaucugcacugggauaacgucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacggcggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucuauuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57937 - RNA, 1758 nt, Artificial Sequence
  hemagglutinin__InfluenzaB__AGX20767
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuguugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57938 - RNA, 1758 nt, Artificial Sequence
  hemagglutinin__InfluenzaB__AGX20778
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaagguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57939 - RNA, 1758 nt, Artificial Sequence
  hemagglutinin__InfluenzaB__AGX20789
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacggcgaaauacuagaacuagacgagaaaguggaugaucucagagcugauacaauaagcucgcaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57940 - RNA, 1758 nt, Artificial Sequence
  hemagglutinin__InfluenzaB__AGX20800
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgaugaauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57941 - RNA, 1758 nt, Artificial Sequence
  hemagglutinin__InfluenzaB__AGX20811
augaaggcaauaauuguacuacucaugguaguaacauccaaugcagaucgaaucugcacugggauaacaucgucaaacucaccacauaucgucaaaacugccacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57942 - RNA, 1758 nt, Artificial Sequence; identical to SEQ ID NO: 57941
  hemagglutinin__InfluenzaB__AGX20822

SEQ ID NO: 57943 - RNA, 1758 nt, Artificial Sequence
  hemagglutinin__InfluenzaB__AGX20833
augaaggcaauaauuguacuacucaugguaguaacauccaaugcagaucgaaucugcacugggauaacaucgucaaacucaccacauaucgucaaaacugccacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuuaagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57944 - RNA, 1758 nt, Artificial Sequence
  hemagglutinin__InfluenzaB__AGX20844
augaaggcaauaauuguacuacucaugguaguaacauccaaugcagaucgaaucugcacugggauaacaucgucaaacucaccacauaucgucaaaacugccacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcauggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57945 - RNA, 1758 nt, Artificial Sequence
  hemagglutinin__InfluenzaB__AGX20855
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagagguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaaaaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57946 - RNA, 1758 nt, Artificial Sequence; identical to SEQ ID NO: 57941
  hemagglutinin__InfluenzaB__AGX20866

SEQ ID NO: 57947 - RNA, 1758 nt, Artificial Sequence; identical to SEQ ID NO: 57230
  hemagglutinin__InfluenzaB__AGX20877

SEQ ID NO: 57948 - RNA, 1758 nt, Artificial Sequence
  hemagglutinin__InfluenzaB__AGX20888
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauagcgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaaguaagccuuacuacacaggggaacaugcaaaggccauaggaaauugcccaauaugggugaagacacccuugaagcuggccaauggaaccaaauauagaccuccugcaaaacuauuaaaggaaagagguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaaaaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57949 - RNA, 1758 nt, Artificial Sequence; identical to SEQ ID NO: 57230
  hemagglutinin__InfluenzaB__AGX20899

SEQ ID NO: 57950 - RNA, 1758 nt, Artificial Sequence; identical to SEQ ID NO: 57230
  hemagglutinin__InfluenzaB__AGX20910

SEQ ID NO: 57951 - RNA, 1758 nt, Artificial Sequence
  hemagglutinin__InfluenzaB__AGX20921
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuuaccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57952 - RNA, 1758 nt, Artificial Sequence
  hemagglutinin__InfluenzaB__AGX20932
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggaccauacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacccaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaaaguaauaaaaggauccuugccuuuaauuggagaagcagauugccuccacgaaaaauaugguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaauucuuugagugagcuggaaguaaagaaucuucaaagacuaagcggugccauggaugaacuccacaaugaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgaccgaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57953 - RNA, 1758 nt, Artificial Sequence
  hemagglutinin__InfluenzaB__AGX20943
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57954 - RNA, 1758 nt, Artificial Sequence; identical to SEQ ID NO: 57953
  hemagglutinin__InfluenzaB__AGX20954

SEQ ID NO: 57955 - RNA, 1758 nt, Artificial Sequence
  hemagglutinin__InfluenzaB__AGX20965
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuuggguagaccaaaaugcacggggaaaauacccucggcaagaguuucaauacuccaugaagucagaccuguuacaucugggugcuuuccuauaaugcacgacagaacaaaaauuagacagcugccuaaucuucuccgaggauacgaacauaucagauuaucaacucauaacguuaucaaugcagaaaaugcaccgggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcuuuauggggacucaaagccccagaaguucaccucaucugccaacggagugaccacacauuacguuucacagauugguggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagacccccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugaugauggguuggauaaccauacuauacugcuuuacuacucaacugcugccuccaguuuggcuguaacacugaugauagcuaucuuuguuguuuauauggucuccagagacaauguuucuugcuccaucugucuauaa

SEQ ID NO: 57956 - RNA, 1758 nt, Artificial Sequence
  hemagglutinin__InfluenzaB__AGX20976
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacggcgaaauacuagaacuagacgagaaaguggaugaucucagagcugauacaauaagcucgcaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57957 - RNA, 1758 nt, Artificial Sequence
  hemagglutinin__InfluenzaB__AGX20987
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggaccauacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaaaguaauaaaaggauccuugccuuuaauuggagaagcagauugccuccacgaaaaauaugguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaauucuuugagugagcuggaaguaaagaaucuucaaagacuaagcggugccauggaugaacuccacaaugaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57958 - RNA, 1758 nt, Artificial Sequence
  hemagglutinin__InfluenzaB__AGX20998
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaucaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57959 - RNA, 1758 nt, Artificial Sequence
  hemagglutinin__InfluenzaB__AGX21009
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucauugaauauuacugcugcaucuuuaaaugacgauggauuggauaaucauaccauacugcuuuacuacucaacugcugccuccaguuuggcuguaacacugaugauagcuaucuuuguuguuuauaugaucuccagagacaauguuucuugcuccaucugucuauaa

SEQ ID NO: 57960 - RNA, 1758 nt, Artificial Sequence
  hemagglutinin__InfluenzaB__AGX21020
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuaaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucagagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcuauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57961 - RNA, 1758 nt, Artificial Sequence; identical to SEQ ID NO: 57230
  hemagglutinin__InfluenzaB__AGX21031

SEQ ID NO: 57962 - RNA, 1758 nt, Artificial Sequence
  hemagglutinin__InfluenzaB__AGX21042
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaauacagaaaaugcaccaggaggacccuacaaaauuggaaccucagggucuugcccuaacguuaccaauggaaacggauucuucgcaacaauggcuugggcugucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacgggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuccaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucccuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57963 - RNA, 1758 nt, Artificial Sequence; identical to SEQ ID NO: 57520
  hemagglutinin__InfluenzaB__AGX21053

SEQ ID NO: 57964 - RNA, 1758 nt, Artificial Sequence
  hemagglutinin__InfluenzaB__AGX21064
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaaguaagccuuacuacacaggggaacaugcaaaggccauaggaaauugcccaauaugggugaagacacccuugaagcuggccaauggaaccaaauauagaccuccugcaaaacuauuaaaggaaagagguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaaaaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57965 - RNA, 1758 nt, Artificial Sequence; identical to SEQ ID NO: 57189
  hemagglutinin__InfluenzaB__AGX21075

SEQ ID NO: 57966 - RNA, 1758 nt, Artificial Sequence; identical to SEQ ID NO: 57519
  hemagglutinin__InfluenzaB__AGX21084

SEQ ID NO: 57967 - RNA, 1758 nt, Artificial Sequence
  hemagglutinin__InfluenzaB__AGX21095
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuaaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccgucuggggguuccacuccgacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcuauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57968 - RNA, 1758 nt, Artificial Sequence
  hemagglutinin__InfluenzaB__AGX21106
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgaggcccaaauggcaaagcucuauggggacucaaagccccagaaguucaccucaucugccaacggagugaccacacauuauguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57969 - RNA, 1758 nt, Artificial Sequence
  hemagglutinin__InfluenzaB__AGX21117
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacaccuaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggggcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57970 - RNA, 1758 nt, Artificial Sequence
  hemagglutinin__InfluenzaB__AGX21128
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaauacagaaaaugcaccaggaggacccuacaaaauuggaaccucagggucuugcccuaacguuaccaauggaaacggauucuucgcaacaauggcuugggcugucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacgggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaaacuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuccaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucccuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57971 - RNA, 1758 nt, Artificial Sequence
  hemagglutinin__InfluenzaB__AGX21139
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcgacuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57972 - RNA, 1758 nt, Artificial Sequence
  hemagglutinin__InfluenzaB__AGX21150
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuggaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57973 - RNA, 1758 nt, Artificial Sequence
  hemagglutinin__InfluenzaB__AGX21161
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuucgcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagauggaggacuaccacaaagugguagaauuguuguugauuacauggugcaaaaaucugggaaaacaggaacuauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57974 - RNA, 1758 nt, Artificial Sequence; identical to SEQ ID NO: 57230
  hemagglutinin__InfluenzaB__AGX21172

SEQ ID NO: 57975 - RNA, 1758 nt, Artificial Sequence
  hemagglutinin__InfluenzaB__AGX21183
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuaaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccgucuggggguuccacuccgacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaaaccuuacuacacaggggaacaugcaaaggcuauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccaaaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57976 - RNA, 1758 nt, Artificial Sequence; identical to SEQ ID NO: 57230
  hemagglutinin__InfluenzaB__AGX21194

SEQ ID NO: 57977 - RNA, 1758 nt, Artificial Sequence
  hemagglutinin__InfluenzaB__AGX21205
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcaaaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57978 - RNA, 1758 nt, Artificial Sequence
  hemagglutinin__InfluenzaB__AGX21216
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggcugucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuccaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 57979 - RNA, 1758 nt, Artificial Sequence; identical to SEQ ID NO: 57144
  hemagglutinin__InfluenzaB__AGX21227

SEQ ID NO: 57980 - RNA, 1758 nt, Artificial Sequence
  hemagglutinin__InfluenzaB__AGX21238
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuaaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccgucuggggguuccacuccgacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaauggcaggagcaagguaauaaaaggauccuugccuuuaauuggagaagcagauugccuccacgaaaaauacgguggauuaaacaaaagcaagccuuacuacacaggggaacaugcaaaggcuauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauaugaucuccagagacaauguuucuugcuccaucugucuauaa

SEQ ID NO: 57981 - RNA, 1758 nt, Artificial Sequence
  hemagglutinin__InfluenzaB__AGX21249
augaaggcaauaauuguacuacucaugguaguaacauccaaugcagaucgaaucugcacugggauaacaucgucaaacucaccacauaucgucaaaacugcuacucaaggggaggucaaugugacugguguaauaccacuaacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaaaguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57982 - RNA, 1758 nt, Artificial Sequence
  hemagglutinin__InfluenzaB__AGX21260
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagagggaaacuaugcccaaaaugccucaacugcacagaucuggacguagccuuaggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucagagagguauuuuauugccucaaaggguguggugcgcaaguggcaggagcaagguaauaaaaggauccuugccuuuaauuggagaagcagauugccuccacgaaaaauacgguggauuaaacaaaagcaagccuuacuacacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucucccuaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57983 - RNA, 1758 nt, Artificial Sequence; identical to SEQ ID NO: 57973
  hemagglutinin__InfluenzaB__AGX21271

SEQ ID NO: 57984 - RNA, 1758 nt, Artificial Sequence
  hemagglutinin__InfluenzaB__AGX21282
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaucacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcaaaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57985 - RNA, 1758 nt, Artificial Sequence
  hemagglutinin__InfluenzaB__AGX21293
augaaggcaauaauuguacuacucaugguaguaacauccaaugcggaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuaaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccgucuggggguuccacuccgacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcuauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57986 - RNA, 1758 nt, Artificial Sequence; identical to SEQ ID NO: 57230
  hemagglutinin__InfluenzaB__AGX21304

SEQ ID NO: 57987 - RNA, 1758 nt, Artificial Sequence
  hemagglutinin__InfluenzaB__AGX21315
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57988 - RNA, 1758 nt, Artificial Sequence; identical to SEQ ID NO: 57953
  hemagglutinin__InfluenzaB__AGX21326

SEQ ID NO: 57989 - RNA, 1758 nt, Artificial Sequence
  hemagglutinin__InfluenzaB__AGX21337
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaaggagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcauccuuaaaugacgauggauuggauaaccauaccauacugcuuuacuacucaacugcugccuccaguuuggcuguaacacugaugauagcuaucuuuguuguuuauauggucuccagagacaauguuucuugcuccaucugucuauaa

SEQ ID NO: 57990 - RNA, 1758 nt, Artificial Sequence; identical to SEQ ID NO: 57967
  hemagglutinin__InfluenzaB__AGX21348

SEQ ID NO: 57991 - RNA, 1758 nt, Artificial Sequence
  hemagglutinin__InfluenzaB__AGX21359
augaaggcaauaauuguacuacucaugguaguaacauccaaugcagaucgaaucugcacugggauaacaucgucaaacucaccacaugucgucaaaacugcuacucaaggggaggucaauguaaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaauguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57992 - RNA, 1758 nt, Artificial Sequence
  hemagglutinin__InfluenzaB__AGX21370
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcauggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggaccauacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57993 - RNA, 1758 nt, Artificial Sequence
  hemagglutinin__InfluenzaB__AGX21381
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacauuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57994 - RNA, 1758 nt, Artificial Sequence
  hemagglutinin__InfluenzaB__AGX21392
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaagcccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 57995 - RNA, 1758 nt, Artificial Sequence
  hemagglutinin__InfluenzaB__AGX21403
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuucgcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagauggaggacuaccacaaagugguagaauuguuguugauuacauggugcaaaaaucugggaaaacaggaacuauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcaguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucaacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57996 - RNA, 1758 nt, Artificial Sequence
  hemagglutinin__InfluenzaB__AGX21414
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacagauccauuaacaauagaaguaccauacauuuguacagaaggagaagaccaaauuaccguuuggggguuccacucugauaacgagacccaaauggcaaagcucuauggggacucaaagccccagaaguucaccucaucuuccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacccaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57997 - RNA, 1758 nt, Artificial Sequence
  hemagglutinin__InfluenzaB__AGX21425
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggcggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 57998 - RNA, 1758 nt, Artificial Sequence
  hemagglutinin__InfluenzaB__AGX21436
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacuguugccuccaguuuggcuguaacacugaugauagcuaucuuuguuguuuauauggucuccagagacaauguuucuugcuccaucugucuauaa

SEQ ID NO: 57999 - RNA, 1758 nt, Artificial Sequence; identical to SEQ ID NO: 57230
  hemagglutinin__InfluenzaB__AGX21447

SEQ ID NO: 58000 - RNA, 1758 nt, Artificial Sequence; identical to SEQ ID NO: 57964
  hemagglutinin__InfluenzaB__AGX21458

SEQ ID NO: 58001 - RNA, 1758 nt, Artificial Sequence
  hemagglutinin__InfluenzaB__AGX21469
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuuaccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagagguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaaaaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58002 - RNA, 1758 nt, Artificial Sequence
  hemagglutinin__InfluenzaB__AGX21480
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugaagauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58003 - RNA, 1758 nt, Artificial Sequence; identical to SEQ ID NO: 57230
  hemagglutinin__InfluenzaB__AGX21491

SEQ ID NO: 58004 - RNA, 1758 nt, Artificial Sequence
  hemagglutinin__InfluenzaB__AGX21502
augaaggcaauaauuguacuacucaugguaguaacauccaaugcagaucgaaucugcacugggauaacaucgucaaacucaccacauaucgucaaaacugcuacucaaggggaggucaauguaacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58005 - RNA, 1758 nt, Artificial Sequence
  hemagglutinin__InfluenzaB__AGX21513
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucucauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaaacugaagaaaaugcugggcccuucugcuguagaaauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58006 - RNA, 1758 nt, Artificial Sequence; identical to SEQ ID NO: 57519
  hemagglutinin__InfluenzaB__AGX21524

SEQ ID NO: 58007 - RNA, 1758 nt, Artificial Sequence
  hemagglutinin__InfluenzaB__AGX21535
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacagugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaaucagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58008 - RNA, 1758 nt, Artificial Sequence
  hemagglutinin__InfluenzaB__AGX21546
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuaaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccgucuggggguuccacuccgacaacgagacccaaauggcaaagcucuauggggacucaaagccccagaaguucaccucaucugccaacggagugaccacacauuacguuucacagauugguggcuucccaaaccaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcuauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58009 - RNA, 1758 nt, Artificial Sequence
  hemagglutinin__InfluenzaB__AGX21557
augaaggcaauaauuguacuacucaugguaguaacauccaaugcagaucgaaucugcacugggauaacaucgucaaacucaccacaugucgucaaaacugcuacucaaggggaggucaaugugaccgguguaauaacacugacaacaacacccaccaaaucucauuuugcaaaucucaaaggaacagaaaccagggggaaacuaugcccaaaaugccuaaacugcacagaucuggacguagccuugggcagaccaaaaugcacggggaaaauacccucggcaagaguuucaauacuccaugaagucagaccuguuacaucugggugcuuuccuauaaugcaugauagaacaaaaauuagacagcugcccaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcuauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58010 - RNA, 1758 nt, Artificial Sequence
  hemagglutinin__InfluenzaB__AGX21568
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuaugaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58011 - RNA, 1758 nt, Artificial Sequence
  hemagglutinin__InfluenzaB__AGX21579
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacagggaaaauacccucggcaagaguuucaauacuccaugaagucagaccuguuacaucugggugcuuuccuauaaugcacgacagaacaaaaauuagacagcugccuaaccuucucagaggauacgaacauaucagauuaucaacucauaacguuaucaaugcagaaaaugcaccaggaggacccuacaaaauuggaaccucagggucuugcccuaacguuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaaguaagccuuacuacacaggggaacaugcaaaggccauaggaaauugcccaauaugggugaagacacccuugaagcuggccaauggaaccaaauauagaccuccugcaaaacuauuaaaggaaagagguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaaaaaucuucaaagacuaagcggugccauggaugaacuccacaacgaaauacuagaacuagacgaaaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58012 - RNA, 1758 nt, Artificial Sequence; identical to SEQ ID NO: 57987
  hemagglutinin__InfluenzaB__AGX21590

SEQ ID NO: 58013 - RNA, 1758 nt, Artificial Sequence
  hemagglutinin__InfluenzaB__AGX21601
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuaaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaauacagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcuauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58014 - RNA, 1758 nt, Artificial Sequence
  hemagglutinin__InfluenzaB__AGX21611
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagagggaaacuaugcccaaaaugccucaacugcacagaucuggacguagccuuaggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucagagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaagccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacgauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucucccuaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58015 - RNA, 1758 nt, Artificial Sequence
  hemagglutinin__InfluenzaB__AGX21622
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58016 - RNA, 1758 nt, Artificial Sequence
  hemagglutinin__InfluenzaB__AGX21633
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaagacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58017 - RNA, 1758 nt, Artificial Sequence
  hemagglutinin__InfluenzaB__AGX21644
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauugggaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58018 - RNA, 1758 nt, Artificial Sequence
  hemagglutinin__InfluenzaB__AGX21655
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacacuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauaggaaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuauuuuuguuguuuauauggucuccagagacaauguuucuugcuccaucugucuauaa

SEQ ID NO: 58019 - RNA, 1758 nt, Artificial Sequence
  hemagglutinin__InfluenzaB__AGX21666
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucucauggggcacauggaguagcgguggcagcagaccuuaagagcacucaagaggccauaaacaagauaacaaaaaaucucaacucuuugagugaguuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaaacugaagaaaaugcugggcccuucugcuguagaaauagggaauggaugcuuugaaaccaaacacaagugcaaccagaccugucucgacaaaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58020 - RNA, 1758 nt, Artificial Sequence
  hemagglutinin__InfluenzaB__AGX21677
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuuaaagcuggccaauggaaccaaauauagaccuccugcaaaacuauuaaaggaaagggguuucuucggugcuauugcuggcuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58021 - RNA, 1758 nt, Artificial Sequence
  hemagglutinin__InfluenzaB__AGX21688
augaaggcaauaauuguacuacucaugguaguaacauccaaugcagaucgaaucugcacugggauaacaucgucaaacucaccacauguagucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagauuuggacguagccuugggcagaccaaaaugcacggggaaaauacccucugcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauuggcggcuucccaaaucaaacagaagauggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuucuaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcauccuuaaaugacgauggauuggauaaccauaccauacugcuuuacuacucaacugcugccuccaguuuggcuguaacacugaugauagcuaucuuuguuguuuauauggucuccagagacaauguuucuugcuccaucugucuauaa

SEQ ID NO: 58022 - RNA, 1758 nt, Artificial Sequence
  hemagglutinin__InfluenzaB__AGX21699
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuaaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccgucuggggguuccacuccgacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggcuauaggaaauugcccaauaugggugaaaacacccuugaaucuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaaugggugcuuugaaaccaaacacaagugcaaccagaccugucucgacagaauagcugcugguaccuuugaugcaggagaauuuucucuccccaccuuugauucacugaauauuacugcugcaucuuuaagugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58023 - RNA, 1758 nt, Artificial Sequence
  hemagglutinin__InfluenzaB__AGX21710
augaaggcaauaauuguacuacucaugguaguaacauccaaugcagaucggaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacugggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaauacagaaaaugcaccaggaggacccuacaaaauuggaaccucagggucuugcccuaacguuaccaauggaaacggauucuucgcaacaauggcuugggcugucccaaaaaacgacaaaaacaaaacagcaacaaauccacuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacgggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggagguaaagaaucuccaaagacuaagcggugccauggaugaacuccacaacgaaauacuagaacuagaugagaaaguggaugaucucagagcugauacaauaagcucacaaauagagcucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucccuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauag

SEQ ID NO: 58024 - RNA, 1758 nt, Artificial Sequence; identical to SEQ ID NO: 57230
  hemagglutinin__InfluenzaB__AGX21721

SEQ ID NO: 58025 - RNA, 1755 nt, Artificial Sequence
  hemagglutinin__InfluenzaB__AGX21732
augaaggcaauaauuguacuacucaugguaguaacauccaaugcagaucgaaucugcacugggauaacaucgucaaacucaccucauguggucaaaacagcuacucaaggggaggucaaugugacuggugcgauaccauugacaacaacaccaacaaaaucucauuuugcaaaucucaaaggaacaaagaccagagggaaacuaugcccaaccugucucaacugcacagauuuggauguggccuugggcggaccaauguguguggggaucacaccuucggcaaaagcuucaauacuccacgaagucagaccugucacaucuggaugcuuuccuauaaugcaugacagaacaaaaaucagacagcuacccaaucuucucagaggauaugaaaaaaucagauuaucagcccaaaacguuaucaacgcagaaaaggcaccaggaggacccuacaaacuuggaacuucaggaucuugcccuaacgcuaccaguaaaagcggauuuuucgcaacaauggcuugggcugucccaagggacgauaacaaaacagcaacgaauccacuaacaguagaaguaccacacaucugugcaaacgaagaagaccaaauuacuguuuggggguuccauucugauaacaaaacccaaaugaaaaaccucuauggagacucaaauccucagaaguucaccucaucugcuaauggaauaaccacacauuauguuucucagauuggcggcuucccggaucaaacagaagacggagggcuaccacaaaguggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggagggaaugauugcagguuggcacggauacacaucucacggagcacauggaguggcaguggcagcagaucuuaagaguacgcaagaagccauaaacaagauaacaaaaaaucucaauucucugagugagcuagaaguaaagaaucuucaaagacuaaguggugccauggaugaacuccauaacgaaauacucgagcuggaugagaaaguggaugaucucagagcagauacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugccuagacaggauagcugcuggcaccuuuaaugcaggagaauuuucucuucccacuuuugauucacugaacauuacugcugcaucuuuaaacgaugauggauuggauaaccauacuauacugcucuacuacucaacugcugcuucuaguuuggcuguaacauugaugauagcuauuuuuauuguuuauaugaucuccagagacaauguuucuugcuccaucugucuauag

SEQ ID NO: 58026 - RNA, 1755 nt, Artificial Sequence
  hemagglutinin__InfluenzaB__AGX21743
augaaggcaauaauuguacuacucaugguaguaacauccaacgcagaucgaaucugcacugggauaacaucuucaaacucaccucauguggucaaaacagcuacucaaggggaggucaaugugacuggugugauaccacugacaacaaccccaacaaaaucucauuuugcaaaucucaaaggaacaaggaccagagggaaacuaugcccagacugucucaacugcacagaucuggauguggccuugggcagaccaauguguguggggaccacacccucggcaaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcacuaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaaaaaccucuauggagacucaaauccucaaaaguucaccucaucugcuaauggaguaaccacacauuauguuucucagauuggcggcuucccagaccaaacagaagacggaggacugccacaaagcggcagaauuguuguugauuacauggugcaaaaaccugggaaaacaggaacaauugucuaucaaagagguguuuuguugccucaaaagguguggugcgcgaguggcaagagcaaaguaauaaaaggguccuugccuuuaauuggugaagcagauugccuucaugaaaaauacgguggguuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugaaaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58027 - RNA, 1755 nt, Artificial Sequence
  hemagglutinin__InfluenzaB__AGX21754
augaaggcaauaauuguacuacucaugguaguaacauccaaugcagaucgaaucugcacugggauaacaucgucaaacucaccucauguggucaaaacagcuacucaaggggaggucaaugugacuggugcgauaccauugacaacaacaccagcaaaaucucauuuugcaaaucucaaaggaacaaagaccagagggaaacuaugcccaaccugucucaacugcacagauuuggauguggccuugggcggaccaauguguguggggaucacaccuucggcaaaagcuucaauacuccacgaagucagaccugucacaucuggaugcuuuccuauaaugcaugacagaacaaaaaucagacagcuacccaaucuucucagaggauaugaaaaaaucagauuaucagcccaaaacguuaucaacgcagaaaaggcaccaggaggacccuacaaacuuggaacuucaggaucuugcccuaacgcuaccaguaaaagcggauuuuucgcaacaauggcuugggcugucccaagggacgauaacaaaacagcaacgaauccacuaacaguagaaguaccacacaucugugcaaacgaagaagaccaaauuacuguuuggggguuccauucugauaacaaaacccaaaugaaaaaccucuauggagacucaaauccucagaaguucaccucaucugcuaauggaauaaccacacauuauguuucucagauuggcggcuucccggaucaaacagaagacggagggcuaccacaaaguggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggagggaaugauugcagguuggcacggauacacaucucacggagcacauggaguggcaguggcagcagaucuuaagaguacgcaagaagccauaaacaagauaacaaaaaaucucaauucucugagugagcuagaaguaaagaaucuucaaagacuaaguggugccauggaugaacuccauaacgaaauacucgagcuggaugagaaaguggaugaucucagagcagauacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugccuagacaggauagcugcuggcaccuuuaaugcaggagaauuuucucuucccacuuuugauucacugaacauuacugcugcaucuuuaaacgaugauggauuggauaaccauacuauacugcucuacuacucaacugcugcuucuaguuuggcuguaacauugaugauagcuauuuuuauuguuuauaugaucuccagagacaauguuucuugcuccaucugucuauag

SEQ ID NO: 58028 - RNA, 1755 nt, Artificial Sequence
  hemagglutinin__InfluenzaB__AGX21776
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaucacaccuucggcaaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauaggccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugaaaagguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacaucacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58029 - RNA, 1758 nt, Artificial Sequence; identical to SEQ ID NO: 57563
  hemagglutinin__InfluenzaB__AGX21787

SEQ ID NO: 58030 - RNA, 1755 nt, Artificial Sequence
  hemagglutinin__InfluenzaB__AGX21798
augaaggcaauaauuguacuacucaugguaguaacauccaaugcagaucgaaucugcacugggauaacaucuucaaacucaccucauguggucaaaacagccacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcaaaagcuucaauacuccacgaagucagaccuguuacauccgggugcuuuccuauaaugcacgacagaacaaaaaucagacaacuacccaaucuucucagaggauaugaaaauaucagguuaucaacccaaaacguuaucgaugcagaaaaggcaccaggaggacccuacagacuuggaaccucagggucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaacccaaaugaagaaccucuauggagacucaaauccucaaaaguucaccucaucugcuaauggaguaacuacacauuauguuucucagauuggcggcuucccagaucaaacagaagacggaggacuaccacaaagcggcagaauuguuguugauuacauggugcaaaaaccugggaaaacaggaacaauugucuaucaaagagguguuuuguugccucaaaagguguggugcgcgagugguaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58031 - RNA, 1755 nt, Artificial Sequence
  hemagglutinin__InfluenzaB__AGX21809
augaaggcaauaauuguacuacucaugguaguaacauccaaugcagaucgaaucugcacugggauaacaucuucaaacucaccucauguggucaaaacagccacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcaaaagcuucaauacuccacgaagucagaccuguuacauccgggugcuuuccuauaaugcaugacagaacaaaaaucagacaacuacccaaucuucucagaggauaugaaaauaucagguuaucaacccaaaacguuaucgaugcagaaaaggcaccaggaggacccuacagacuuggaaccucagggucuugcccuaacgcuaccaguaaaagcggauuuuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaacccaaaugaagaaccucuauggagacucaaauccucaaaaguucaccucaucugcuaauggaguaacuacacauuauguuucucagauuggcggcuucccagaucaaacagaagacggaggacuaccacaaagcggcagaauuguuguugauuacauggugcaaaaaccugggaaaacaggaacaauugucuaucaaagagguguuuuguugccucaaaagguguggugcgcgagugguaggagcaaaguaauaaaaggguccuugccuuuaauuggugaagcagauugccuucaugaaaaauacgguggauuaaacaaaagcaggccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58032 - RNA, 1755 nt, Artificial Sequence
  hemagglutinin__InfluenzaB__AGX21820
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaauaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggauugaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58033 - RNA, 1755 nt, Artificial Sequence
  hemagglutinin__InfluenzaB__AGX21831
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58034 - RNA, 1755 nt, Artificial Sequence
  hemagglutinin__InfluenzaB__AGX21842
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuagauguggccuugggcagaccaaugugugugggaaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauucuucgcaacaauggcuugggcugucccaaaggacaacaacaaaaaugcaacgaacccacuaacaguagaaguaccauacguuuguacggaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaauaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58035 - RNA, 1755 nt, Artificial Sequence
  hemagglutinin__InfluenzaB__AGX21853
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuagauguggccuugggcagaccaaugugugugggaaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauucuucgcaacaauggcuugggcugucccaaaggacaacaacaaaaaugcaacgaacccacuaacaguagaaguaccauacguuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaauaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58036 - RNA, 1755 nt, Artificial Sequence
  hemagglutinin__InfluenzaB__AGX21864
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaaaccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugagaaauacgguggauuaaacaaaagcaagccuuacuacacaggagaacaugcaaaagccauaggaaauugcccaauaugggugaaaacaccuuugaagcuugccaauggaacaaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcagcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58037 - RNA, 1755 nt, Artificial Sequence; identical to SEQ ID NO: 57528
  hemagglutinin__InfluenzaB__AGX21875

SEQ ID NO: 58038 - RNA, 1755 nt, Artificial Sequence
  hemagglutinin__InfluenzaB__AGX21886
augaaggcaauaauuguacuacucaugguaguaacauccaaugcagaucgaaucugcacugggauaacaucuucaaacucaccucauguggucaaaacagccacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacaucugggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugcccuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagacccccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggauguuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58039 - RNA, 1755 nt, Artificial Sequence; identical to SEQ ID NO: 57533
  hemagglutinin__InfluenzaB__AGX21897

SEQ ID NO: 58040 - RNA, 1755 nt, Artificial Sequence
  hemagglutinin__InfluenzaB__AGX21908
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuuuggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacagauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58041 - RNA, 1755 nt, Artificial Sequence
  hemagglutinin__InfluenzaB__AGX21919
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaacaucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaucaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaagcaggaacaauugucuaucaaagagguguuuuguugccucaaaagguguggugcgcuaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcucaaucugucuauaa

SEQ ID NO: 58042 - RNA, 1755 nt, Artificial Sequence; identical to SEQ ID NO: 58034
  hemagglutinin__InfluenzaB__AGX21941

SEQ ID NO: 58043 - RNA, 1755 nt, Artificial Sequence
  hemagglutinin__InfluenzaB__AGX21952
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcagcuacccaaucuucucagaggauaugaaaauaucagguuaucaacccaaaacguuaucgaugcagaaaaggcaccaggagggcccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagacccccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggguuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58044 - RNA, 1755 nt, Artificial Sequence; identical to SEQ ID NO: 58034
  hemagglutinin__InfluenzaB__AGX21963

SEQ ID NO: 58045 - RNA, 1755 nt, Artificial Sequence
  hemagglutinin__InfluenzaB__AGX21974
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacucaaaacguuaucgaugcagaaaaggcaccaggaggacccuacagacuuggaaccucaggaucuugcccuaacgcuaccaguaaaagcggauuuuucgcaacaauggcuugggcugucccaaaggucaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcagcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauaugaucuccagagacaacguuucaugcuccaucugucuauaa

SEQ ID NO: 58046 - RNA, 1755 nt, Artificial Sequence; identical to SEQ ID NO: 58034
  hemagglutinin__InfluenzaB__AGX21985

SEQ ID NO: 58047 - RNA, 1755 nt, Artificial Sequence; identical to SEQ ID NO: 57528
  hemagglutinin__InfluenzaB__AGX21996

SEQ ID NO: 58048 - RNA, 1755 nt, Artificial Sequence; identical to SEQ ID NO: 57528
  hemagglutinin__InfluenzaB__AGX22007

SEQ ID NO: 58049 - RNA, 1755 nt, Artificial Sequence
  hemagglutinin__InfluenzaB__AGX22018
augaaggcaauaauuguacuacucaugguaguaacauccaaugcagaucgaaucugcacugggauaacaucuucaaacucaccucacguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuuaggcagaccaauguguguggggaccacaccuucugcgaaagcuucaauacuccacgaagucagaccuguuacaucugggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaaguggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuuacuuuccaacgaaggaauaauaaacagugaagaugagcaucuauuggcacuugagagaaaacuaaagaaaaugcugggccccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuaucuuuauuguuuauauggucuccagagacaacguuucaugcuccaucugucuauaa

SEQ ID NO: 58050 - RNA, 1755 nt, Artificial Sequence; identical to SEQ ID NO: 57533
  hemagglutinin__InfluenzaB__AGX22029

SEQ ID NO: 58051 - RNA, 1755 nt, Artificial Sequence; identical to SEQ ID NO: 57533
  hemagglutinin__InfluenzaB__AGX22040

SEQ ID NO: 58052 - RNA, 1755 nt, Artificial Sequence
  hemagglutinin__InfluenzaB__AGX22051
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacgucaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcggcuucccagaucaaauagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugcacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58053 - RNA, 1755 nt, Artificial Sequence; identical to SEQ ID NO: 57533
  hemagglutinin__InfluenzaB__AGX22062

SEQ ID NO: 58054 - RNA, 1755 nt, Artificial Sequence
  hemagglutinin__InfluenzaB__AGX22073
augaaggcaauaauuguacuacucaugguaguaacauccaaugcagaucgaaucugcacugggauaacaucuucaaacucaccucauguggucaaaacagccacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacaucugggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugcccuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagacccccugcaaaacuauuaaaggaaagggguuucuucggagcuauugcugguuucauagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggauguuucgaaaccaaacacaagugcaaccagaccugcuuagacaggauagcugcuggcaccuucaaugcaggagauuuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58055 - RNA, 1755 nt, Artificial Sequence; identical to SEQ ID NO: 58034
  hemagglutinin__InfluenzaB__AGX22095

SEQ ID NO: 58056 - RNA, 1755 nt, Artificial Sequence; identical to SEQ ID NO: 57528
  hemagglutinin__InfluenzaB__AGX22106

SEQ ID NO: 58057 - RNA, 1755 nt, Artificial Sequence
  hemagglutinin__InfluenzaB__AGX22128
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuagauguggccuugggcagaccaaugugugugggaaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauucuucgcaacaauggcuugggcugucccaaaggacaacaacaaaaaugcaacgaacccacuaacaguagaaguaccauacguuuguacggaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaauaaagaaucuucaaagacuaaguggugccaugaaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58058 - RNA, 1755 nt, Artificial Sequence
  hemagglutinin__InfluenzaB__AGX22139
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcggaagcuucaauacuccacgaagucagaccuguuacauccgggugcuuuccuauaaugcacgacagaacaaaaauuaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuuaagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaaugaaggaauaauaaacagugaagacgaacaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuagcuuggcuguaacauugaugcuagcuauuuuuauuguuuauauggucuccagagacaacguuucaugcuccaucugucuauaa

SEQ ID NO: 58059 - RNA, 1755 nt, Artificial Sequence; identical to SEQ ID NO: 58058
  hemagglutinin__InfluenzaB__AGX22150

SEQ ID NO: 58060 - RNA, 1755 nt, Artificial Sequence; identical to SEQ ID NO: 58058
  hemagglutinin__InfluenzaB__AGX22161

SEQ ID NO: 58061 - RNA, 1755 nt, Artificial Sequence; identical to SEQ ID NO: 58038
  hemagglutinin__InfluenzaB__AGX22172

SEQ ID NO: 58062 - RNA, 1755 nt, Artificial Sequence
  hemagglutinin__InfluenzaB__AGX22183
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcggaagcuucaauacuccacgaagucagaccuguuacauccgggugcuuuccuauaaugcacgacagaacaaaaauuaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuuaagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaaugaaggaauaauaaacagugaagacgaacaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuacuacucaacugcugcuucuagcuuggcuguaacauugaugcuagcuauuuuuauuguuuauauggucuccagagacaacguuucaugcuccaucugucuauaa

SEQ ID NO: 58063 - RNA, 1755 nt, Artificial Sequence; identical to SEQ ID NO: 58058
  hemagglutinin__InfluenzaB__AGX22194

SEQ ID NO: 58064 - RNA, 1755 nt, Artificial Sequence; identical to SEQ ID NO: 58058
  hemagglutinin__InfluenzaB__AGX22205

SEQ ID NO: 58065 - RNA, 1755 nt, Artificial Sequence
  hemagglutinin__InfluenzaB__AGX22216
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacgucaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcggcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58066 - RNA, 1755 nt, Artificial Sequence; identical to SEQ ID NO: 58034
  hemagglutinin__InfluenzaB__AGX22227

SEQ ID NO: 58067 - RNA, 1755 nt, Artificial Sequence
  hemagglutinin__InfluenzaB__AGX22238
augaaggcaauaauuguacuacucaugguaguaacauccaaugcagaucgaaucugcacugggauaacaucuucaaacucaccucauauggucaaaacagccacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacaucugggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugcccuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagacccccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggauguuucgaaaccaaacacaagugcaaccagaccugcuuagauaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58068 - RNA, 1755 nt, Artificial Sequence; identical to SEQ ID NO: 57528
  hemagglutinin__InfluenzaB__AGX22249

SEQ ID NO: 58069 - RNA, 1755 nt, Artificial Sequence
  hemagglutinin__InfluenzaB__AGX22260
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuuuggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccaccuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58070 - RNA, 1755 nt, Artificial Sequence
  hemagglutinin__InfluenzaB__AGX22271
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaagaaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacgucaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucgucugcuaauggaguaaccacacacuauguuucucagauuggcggcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuucugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58071 - RNA, 1755 nt, Artificial Sequence
  hemagglutinin__InfluenzaB__AGX22282
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuuuggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuugaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccaccuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58072 - RNA, 1755 nt, Artificial Sequence
  hemagglutinin__InfluenzaB__AGX22293
augaaggcaauaauuguacuacucaugguaguaacauccaaugcagaucgaaucugcacugggauaacaucuucaaacucaccucacguggucaaaacagcuacucaaggggaggucaauguaacuggugugauaccacugacaacaacaccaacaaaaucuuauuuugcaaaucucaaaggaacaaggaccagagggaaacuaugcccagacugucucaacuguacagaucuggauguggccuuaggcagaccaauguguguggggaccacaccuucugcgaaagcuucaauacuccacgaagucagaccuguuacaucugggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaaguggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaaguucacaaauagaacuugcagucuuacuuuccaacgaaggaauaauaaacagugaagaugagcaucuauuggcacuugagagaaaacuaaagaaaaugcugggccccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuaucuuuauuguuuauauggucuccagagacaacguuucaugcuccaucugucuauaa

SEQ ID NO: 58073 - RNA, 1755 nt, Artificial Sequence
  hemagglutinin__InfluenzaB__AGX22304
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucuacuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuuuggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccaccuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58074 - RNA, 1755 nt, Artificial Sequence; identical to SEQ ID NO: 58038
  hemagglutinin__InfluenzaB__AGX22315

SEQ ID NO: 58075 - RNA, 1755 nt, Artificial Sequence
  hemagglutinin__InfluenzaB__AGX22326
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagagggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaguacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucccuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58076 - RNA, 1755 nt, Artificial Sequence; identical to SEQ ID NO: 58034
  hemagglutinin__InfluenzaB__AGX22337

SEQ ID NO: 58077 - RNA, 1755 nt, Artificial Sequence; identical to SEQ ID NO: 58034
  hemagglutinin__InfluenzaB__AGX22348

SEQ ID NO: 58078 - RNA, 1755 nt, Artificial Sequence
  hemagglutinin__InfluenzaB__AGX22359
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuagauguggccuugggcagaccaaugugugugggaaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauucuucgcaacaauggcuugggcugucccaaaggacaacaacaaaaaugcaacgaacccacuaacaguagaaguaccauacguuuguacggaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaagaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaauaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58079 - RNA, 1755 nt, Artificial Sequence; identical to SEQ ID NO: 57528
  hemagglutinin__InfluenzaB__AGX22370

SEQ ID NO: 58080 - RNA, 1755 nt, Artificial Sequence
  hemagglutinin__InfluenzaB__AGX22381
augaaggcaauaauuguacuacucaugguaguaacaucuaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuauccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuuuggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccaccuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58081 - RNA, 1755 nt, Artificial Sequence; identical to SEQ ID NO: 57533
  hemagglutinin__InfluenzaB__AGX22392

SEQ ID NO: 58082 - RNA, 1755 nt, Artificial Sequence
  hemagglutinin__InfluenzaB__AGX22403
augaaggcaauaauuguacuacucaugguaguaacauccaaugcagaucgaaucugcacugggauaacaucuucaaacucaccucauguggucaaaacagccacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacaucugggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggggacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugcccuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagacccccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggauguuucgaaaccaaacacaagugcaaccagaccugcuuagacaggauagcugcuggcaccuucaaugcaggagauuuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58083 - RNA, 1755 nt, Artificial Sequence; identical to SEQ ID NO: 58038
  hemagglutinin__InfluenzaB__AGX22414

SEQ ID NO: 58084 - RNA, 1755 nt, Artificial Sequence
  hemagglutinin__InfluenzaB__AGX22425
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaagaaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacgucaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaauccaaaugaagaaccucuauggagacucaaauccucaaaaguucaccucaucugcuaauggaguaaccacacacuauguuucucagauuggcggcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58085 - RNA, 1755 nt, Artificial Sequence; identical to SEQ ID NO: 57528
  hemagglutinin__InfluenzaB__AGX22436

SEQ ID NO: 58086 - RNA, 1755 nt, Artificial Sequence
  hemagglutinin__InfluenzaB__AGX22445
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacgucaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcggcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuauuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaaaauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58087 - RNA, 1755 nt, Artificial Sequence
  hemagglutinin__InfluenzaB__AGX22456
augaaggcaauaauuguacuacucaugguaguaacauccaaugcagaucgaaucugcacugggauaacaucuucaagcucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucagcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacagugaaauacucgagcuggaugagaaaguggaugaucucagagcugacacuauaagcucgcaaauagaacuugcagucuugcuuuccaacgaaggaauaauaaacagugaagaugagcaucuacuggcacuugagagaaagcuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauagucuccagagacaacguuucaugcuccaucugucuauaa

SEQ ID NO: 58088 - RNA, 1755 nt, Artificial Sequence
  hemagglutinin__InfluenzaB__AGX22467
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuuuggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguagaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccaccuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58089 - RNA, 1755 nt, Artificial Sequence; identical to SEQ ID NO: 58088
  hemagglutinin__InfluenzaB__AGX22478

SEQ ID NO: 58090 - RNA, 1755 nt, Artificial Sequence
  hemagglutinin__InfluenzaB__AGX22489
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaagcgcuaucgaugcagaaaaggcaccaggagggcccuacagacuuggaaccucaggaucuugcccuaaugcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccaggucaaacagaagacggaggacuaccacaaagcggcagaauuguuguugauuacaugauucaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaccucagagcugacacuauaagcgcacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaagugcaaccagaccugcuuggacaggauagcugcuggcaccuuuaaugcaggagaauuuucucuccccacuuuugacucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58091 - RNA, 1755 nt, Artificial Sequence
  hemagglutinin__InfluenzaB__AGX22500
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuggauguggccuugggcagaccaaugugugugggaaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauuuuuugcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuauuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacuguugcuucuaguuuggcuguaacauugaugcuagcuauuuuuauuguuuauauggucuccagagacaacguuucaugcuccaucugucuauaa

SEQ ID NO: 58092 - RNA, 1755 nt, Artificial Sequence; identical to SEQ ID NO: 58065
  hemagglutinin__InfluenzaB__AGX22511

SEQ ID NO: 58093 - RNA, 1755 nt, Artificial Sequence
  hemagglutinin__InfluenzaB__AGX22522
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccaaacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58094 - RNA, 1755 nt, Artificial Sequence
  hemagglutinin__InfluenzaB__AGX22533
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaagugauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagacuugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58095 - RNA, 1755 nt, Artificial Sequence; identical to SEQ ID NO: 57542
  hemagglutinin__InfluenzaB__AGX22566

SEQ ID NO: 58096 - RNA, 1755 nt, Artificial Sequence; identical to SEQ ID NO: 57535
  hemagglutinin__InfluenzaB__AGX22577

SEQ ID NO: 58097 - RNA, 1755 nt, Artificial Sequence; identical to SEQ ID NO: 57542
  hemagglutinin__InfluenzaB__AGX22588

SEQ ID NO: 58098 - RNA, 1755 nt, Artificial Sequence
  hemagglutinin__InfluenzaB__AGX22599
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuacuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaauaaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucccuccccacuuuugauucauugaacauuacugcugcaucuuuaaaugaugauggauuggauaaccauacuauacugcucuauuacucaacugcugcuucuaguuuggcuguaacauugaugcuagcuauuuuuauugucuauauggucuccagagacaacguuucaugcuccaucugucuauaa

SEQ ID NO: 58099 - RNA, 1755 nt, Artificial Sequence
  hemagglutinin__InfluenzaB__AGX22610
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggagggcccuacagacuuggaaccucagggucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacccaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuacuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugacucacugaacauuacugcugcaucuuugaaugaugauggauuggauaaccauacuauacugcucuauuacucaacugcugcuuccaguuuggcuguaacauugaugcuagcuauuuuuauuguuuauauggucuccagagacaacguuucaugcuccaucugucuauaa

SEQ ID NO: 58100 - RNA, 1755 nt, Artificial Sequence
  hemagglutinin__InfluenzaB__AGX22621
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacaggaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58101 - RNA, 1755 nt, Artificial Sequence; identical to SEQ ID NO: 58094
  hemagglutinin__InfluenzaB__AGX22632

SEQ ID NO: 58102 - RNA, 1755 nt, Artificial Sequence
  hemagglutinin__InfluenzaB__AGX22643
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacgacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaauccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58103 - RNA, 1755 nt, Artificial Sequence
  hemagglutinin__InfluenzaB__AGX22654
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacagcgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58104 - RNA, 1755 nt, Artificial Sequence; identical to SEQ ID NO: 57542
  hemagglutinin__InfluenzaB__AGX22665

SEQ ID NO: 58105 - RNA, 1755 nt, Artificial Sequence; identical to SEQ ID NO: 57542
  hemagglutinin__InfluenzaB__AGX22676

SEQ ID NO: 58106 - RNA, 1755 nt, Artificial Sequence; identical to SEQ ID NO: 58098
  hemagglutinin__InfluenzaB__AGX22687

SEQ ID NO: 58107 - RNA, 1755 nt, Artificial Sequence; identical to SEQ ID NO: 57542
  hemagglutinin__InfluenzaB__AGX22698

SEQ ID NO: 58108 - RNA, 1755 nt, Artificial Sequence
  hemagglutinin__InfluenzaB__AGX22709
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacgacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugagaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacuagagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58109 - RNA, 1755 nt, Artificial Sequence
  hemagglutinin__InfluenzaB__AGX22720
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuuugcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggagcaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcucuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58110 - RNA, 1755 nt, Artificial Sequence; identical to SEQ ID NO: 57542
  hemagglutinin__InfluenzaB__AGX22731

SEQ ID NO: 58111 - RNA, 1755 nt, Artificial Sequence; identical to SEQ ID NO: 58103
  hemagglutinin__InfluenzaB__AGX22742

SEQ ID NO: 58112 - RNA, 1755 nt, Artificial Sequence
  hemagglutinin__InfluenzaB__AGX22753
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccagcaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaauccacuaacaguagagguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugauacaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58113 - RNA, 1755 nt, Artificial Sequence
  hemagglutinin__InfluenzaB__AGX22764
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagagguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugauacaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaccaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58114 - RNA, 1755 nt, Artificial Sequence
  hemagglutinin__InfluenzaB__AGX22775
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcggcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccguugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaagacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58115 - RNA, 1755 nt, Artificial Sequence
  hemagglutinin__InfluenzaB__AGX22786
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagagguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugauacaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucauggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58116 - RNA, 1755 nt, Artificial Sequence
  hemagglutinin__InfluenzaB__AGX22797
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagagguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugauacaaaaaccugggaaaacaggaacaauugucuaucaaagagguguuuuguuuccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucauggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58117 - RNA, 1755 nt, Artificial Sequence
  hemagglutinin__InfluenzaB__AGX22808
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaauuagccaaucuucucagaggauaugaaaauaucagguuaucaacccaaaacguuaucgaugcagaaaaggcaccaggaggacccuauagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugauacaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58118 - RNA, 1755 nt, Artificial Sequence; identical to SEQ ID NO: 57542
  hemagglutinin__InfluenzaB__AGX22819

SEQ ID NO: 58119 - RNA, 1755 nt, Artificial Sequence; identical to SEQ ID NO: 57542
  hemagglutinin__InfluenzaB__AGX22830

SEQ ID NO: 58120 - RNA, 1755 nt, Artificial Sequence
  hemagglutinin__InfluenzaB__AGX22841
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagagguaccauacauuuguaaagaaggggaagaccaaauuacuguuuggggguuccauucagauaacaaaacccaaaugaagaaccucuauggagacucaaauccucaaaaguucaccucaucugcugauggaguaaccacacauuauguuucucagauuggcggcuucccagaucaaacagaagacggaggacuaccacaaagcggcagaauugucguugauuacaugauacaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58121 - RNA, 1755 nt, Artificial Sequence
  hemagglutinin__InfluenzaB__AGX22852
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacgacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuuccccgaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58122 - RNA, 1755 nt, Artificial Sequence; identical to SEQ ID NO: 57542
  hemagglutinin__InfluenzaB__AGX22863

SEQ ID NO: 58123 - RNA, 1755 nt, Artificial Sequence
  hemagglutinin__InfluenzaB__AGX22874
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagagguaccauacauuuguaaagaaggggaagaccaaauuacuguuuggggguuccauucagauaacaaaacccaaaugaaaaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugauacaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucauggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugccgcuucuaguuuggcuguaacauugaugcuagcuauuuuuauuguuuauauggucuccagagacaacguuucaugcuccaucugucuauaa

SEQ ID NO: 58124 - RNA, 1755 nt, Artificial Sequence
  hemagglutinin__InfluenzaB__AGX22885
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuacuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucagaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucccuccccacuuuugauucauugaacauuacugcugcaucuuuaaaugaugauggauuggauaaccauacuauacugcucuauuacucaacugcugcuucuaguuuggcuguaacauugaugcuagcuauuuuuauugucuauauggucuccagagacaacguuucaugcuccaucugucuauaa

SEQ ID NO: 58125 - RNA, 1755 nt, Artificial Sequence; identical to SEQ ID NO: 58103
  hemagglutinin__InfluenzaB__AGX22896

SEQ ID NO: 58126 - RNA, 1755 nt, Artificial Sequence
  hemagglutinin__InfluenzaB__AGX22907
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauacagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacagcguuucaugcuccaucugucuauaa

SEQ ID NO: 58127 - RNA, 1755 nt, Artificial Sequence
  hemagglutinin__InfluenzaB__AGX22918
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacucaaaugaagaaccucuauggagacucaaauccucaaaaguucaccucaucugcuaauggaguaaccacacauuauguuucucagauugguggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagcuauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58128 - RNA, 1755 nt, Artificial Sequence
  hemagglutinin__InfluenzaB__AGX22929
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58129 - RNA, 1755 nt, Artificial Sequence; identical to SEQ ID NO: 58115
  hemagglutinin__InfluenzaB__AGX22940

SEQ ID NO: 58130 - RNA, 1755 nt, Artificial Sequence
  hemagglutinin__InfluenzaB__AGX22951
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuacuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaauaaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucccuccccacuuuugauucauugaacauuacugcugcaucuuuaaaugaugauggauuggauaaucauacuauacugcucuauuacucaacugcugcuucuaguuuggcuguaacauugaugcuagcuauuuuuauugucuauauggucuccagagacaacguuucaugcuccaucugucuauaa

SEQ ID NO: 58131 - RNA, 1755 nt, Artificial Sequence
  hemagglutinin__InfluenzaB__AGX22962
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58132 - RNA, 1755 nt, Artificial Sequence
  hemagglutinin__InfluenzaB__AGX22973
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagcuauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58133 - RNA, 1755 nt, Artificial Sequence
  hemagglutinin__InfluenzaB__AGX22984
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58134 - RNA, 1755 nt, Artificial Sequence; identical to SEQ ID NO: 57541
  hemagglutinin__InfluenzaB__AGX22995

SEQ ID NO: 58135 - RNA, 1755 nt, Artificial Sequence; identical to SEQ ID NO: 57540
  hemagglutinin__InfluenzaB__AGX23006

SEQ ID NO: 58136 - RNA, 1755 nt, Artificial Sequence
  hemagglutinin__InfluenzaB__AGX23017
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaaaucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugacgauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58137 - RNA, 1755 nt, Artificial Sequence
  hemagglutinin__InfluenzaB__AGX23028
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacaaacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58138 - RNA, 1755 nt, Artificial Sequence; identical to SEQ ID NO: 57537
  hemagglutinin__InfluenzaB__AGX23039

SEQ ID NO: 58139 - RNA, 1755 nt, Artificial Sequence
  hemagglutinin__InfluenzaB__AGX23050
augaaggcaauaauuguacuacucaugguaguaacauccaaugcagauagaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucaguccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaggcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58140 - RNA, 1755 nt, Artificial Sequence
  hemagglutinin__InfluenzaB__AGX23061
augaaggcaauaauuguacuacucaugguaguaacauccaaugcagauagaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaggcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58141 - RNA, 1755 nt, Artificial Sequence
  hemagglutinin__InfluenzaB__AGX23072
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuucauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugaucgcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58142 - RNA, 1755 nt, Artificial Sequence; identical to SEQ ID NO: 57542
  hemagglutinin__InfluenzaB__AGX23083

SEQ ID NO: 58143 - RNA, 1755 nt, Artificial Sequence
  hemagglutinin__InfluenzaB__AGX23094
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacuccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugccgguuuccuagaaggaggaugggaaggaaugauugcagguuggcacggauacacaucucacggagcacauggaguggcaguggcggcagaccucaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58144 - RNA, 1755 nt, Artificial Sequence
  hemagglutinin__InfluenzaB__AGX23105
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaagcuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58145 - RNA, 1755 nt, Artificial Sequence
  hemagglutinin__InfluenzaB__AGX23116
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaauuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagagguaccauacauuuguaaagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugauacaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58146 - RNA, 1755 nt, Artificial Sequence; identical to SEQ ID NO: 58128
  hemagglutinin__InfluenzaB__AGX23127

SEQ ID NO: 58147 - RNA, 1755 nt, Artificial Sequence
  hemagglutinin__InfluenzaB__AGX23138
augaaagcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacaugggguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58148 - RNA, 1755 nt, Artificial Sequence
  hemagglutinin__InfluenzaB__AGX23149
augaaggcaauaauuguacuacucaugguaguaacauccaaugcagaucgaaucugcacugggauaacaucuucagacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaaguggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagcuauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58149 - RNA, 1755 nt, Artificial Sequence
  hemagglutinin__InfluenzaB__AGX23160
augaaggcaauaauuguacuacucaugguaguaacauccaaugcagauagaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaucacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaagguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaggcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58150 - RNA, 1755 nt, Artificial Sequence
  hemagglutinin__InfluenzaB__AGX23171
augaaggcaauaauuguacuacucaugguaguaacauccaaugcagauagaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaagguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaggcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58151 - RNA, 1755 nt, Artificial Sequence
  hemagglutinin__InfluenzaB__AGX23182
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuacuuugcaaaucucaaaggaacaaggaccagagggaaacuaugcccagacugucucaacuguacagaucuggauguggccuugggcaggccaauguguguggggaccacaccuucugcaaaagcuucaauacuccacgaagucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucccuccccacuuuugauucauugaacauuacugcugcaucuuuaaaugaugauggauuggauaaccauacuauacugcucuauuacucaacugcugcuucuaguuuggcuguaacauugaugcuagcuauuuuuauugucuauauggucuccagagacaacguuucaugcuccaucugucuauaa

SEQ ID NO: 58152 - RNA, 1755 nt, Artificial Sequence
  hemagglutinin__InfluenzaB__AGX23193
augaaagcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58153 - RNA, 1755 nt, Artificial Sequence; identical to SEQ ID NO: 58115
  hemagglutinin__InfluenzaB__AGX23204

SEQ ID NO: 58154 - RNA, 1755 nt, Artificial Sequence; identical to SEQ ID NO: 58152
  hemagglutinin__InfluenzaB__AGX23215

SEQ ID NO: 58155 - RNA, 1755 nt, Artificial Sequence
  hemagglutinin__InfluenzaB__AGX23226
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagagguaccauacauuuguaaagaaggggaagaccaaauuacuguuuggggguuccauucagauaacaaaacccaaaugaagaaccucuauggagacucaaauccucaaaaguucaccucaucugcuaguggaguaaccacacauuauguuucucagauuggcggcuucccagaucaaacagaagacggaggacuaccacaaagcggcagaauugucguugauuacaugauacaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 58156 - RNA, 1755 nt, Artificial Sequence
  hemagglutinin__InfluenzaB__AGX23237
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaccucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacagcgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58157 - RNA, 1755 nt, Artificial Sequence
  hemagglutinin__InfluenzaB__AGX23248
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagagguaccauacauuuguaaagaaggggaagaccaaauuacuguuuggggguuccauucagauaacaaaacccaaaugaagaaccucuauggagacucaaauccucaaaaguucaccucaucugcuaguggaguaaccacacauuauguuucucagauuggcggcuucccagaucaaacagaagacggaggacuaccacaaagcggcagaauugucguugauuacaugauacaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuaaacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 58158 - RNA, 1755 nt, Artificial Sequence
  hemagglutinin__InfluenzaB__AGX23259
augaaagcaauaauuguacuacucaugguaguaacauccaacgcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaaguggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58159 - RNA, 1755 nt, Artificial Sequence; identical to SEQ ID NO: 58158
  hemagglutinin__InfluenzaB__AGX23270

SEQ ID NO: 58160 - RNA, 1755 nt, Artificial Sequence
  hemagglutinin__InfluenzaB__AGX23281
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaccucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcugccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacagcgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58161 - RNA, 1755 nt, Artificial Sequence
  hemagglutinin__InfluenzaB__AGX23292
augaaagcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaacaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacaugggguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugauacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58162 - RNA, 1755 nt, Artificial Sequence
  hemagglutinin__InfluenzaB__AGX23314
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaagggcaccaggaggacccuacagacuuggaaccucaggaucuugcccuaacgcuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcauggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaggacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58163 - RNA, 1755 nt, Artificial Sequence; identical to SEQ ID NO: 58162
  hemagglutinin__InfluenzaB__AGX23325

SEQ ID NO: 58164 - RNA, 1755 nt, Artificial Sequence; identical to SEQ ID NO: 58162
  hemagglutinin__InfluenzaB__AGX23336

SEQ ID NO: 58165 - RNA, 1755 nt, Artificial Sequence; identical to SEQ ID NO: 58162
  hemagglutinin__InfluenzaB__AGX23347

SEQ ID NO: 58166 - RNA, 1755 nt, Artificial Sequence; identical to SEQ ID NO: 58162
  hemagglutinin__InfluenzaB__AGX23358

SEQ ID NO: 58167 - RNA, 1755 nt, Artificial Sequence; identical to SEQ ID NO: 58162
  hemagglutinin__InfluenzaB__AGX23369

SEQ ID NO: 58168 - RNA, 1755 nt, Artificial Sequence; identical to SEQ ID NO: 58162
  hemagglutinin__InfluenzaB__AGX23380

SEQ ID NO: 58169 - RNA, 1755 nt, Artificial Sequence
  hemagglutinin__InfluenzaB__AGX23391
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacaucugggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58170 - RNA, 1755 nt, Artificial Sequence
  hemagglutinin__InfluenzaB__AGX23413
augaaggcaauaauuguacuacucaugguaguaacauccaaugcagaucgaaucugcacugggauaacaucuucaaacucaccccauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaaaccaaaacguuaucgaugcagaaagggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucaaauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58171 - RNA, 1755 nt, Artificial Sequence
  hemagglutinin__InfluenzaB__AGX23424
augaaggcaauaauuguacuacucaugguaguaacauccaaugcagaucgaaucugcacugggauaacaucuucaaacucaccccauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagcuaaucuucucagaggauaugaaaauaucagguuaucaaaccaaaacguuaucgaugcagaaagggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucaaauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58172 - RNA, 1755 nt, Artificial Sequence
  hemagglutinin__InfluenzaB__AGX23435
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58173 - RNA, 1755 nt, Artificial Sequence; identical to SEQ ID NO: 57548
  hemagglutinin__InfluenzaB__AGX23446

SEQ ID NO: 58174 - RNA, 1755 nt, Artificial Sequence; identical to SEQ ID NO: 58172
  hemagglutinin__InfluenzaB__AGX23457

SEQ ID NO: 58175 - RNA, 1755 nt, Artificial Sequence
  hemagglutinin__InfluenzaB__AGX23468
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58176 - RNA, 1755 nt, Artificial Sequence
  hemagglutinin__InfluenzaB__AGX23479
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaaacuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuggaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58177 - RNA, 1755 nt, Artificial Sequence
  hemagglutinin__InfluenzaB__AGX23490
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucaaauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaauaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacugaagaaaaugcugggucccucugcuguagacauaggaaauggaugcuucgaaaccaaacacaaaugcaaccagaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58178 - RNA, 1755 nt, Artificial Sequence
  hemagglutinin__InfluenzaB__AGX23501
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaacccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58179 - RNA, 1755 nt, Artificial Sequence
  hemagglutinin__InfluenzaB__AGX23512
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuauguccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagacccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58180 - RNA, 1755 nt, Artificial Sequence; identical to SEQ ID NO: 57547
  hemagglutinin__InfluenzaB__AGX23523

SEQ ID NO: 58181 - RNA, 1755 nt, Artificial Sequence
  hemagglutinin__InfluenzaB__AGX23534
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacucaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58182 - RNA, 1755 nt, Artificial Sequence; identical to SEQ ID NO: 58181
  hemagglutinin__InfluenzaB__AGX23545

SEQ ID NO: 58183 - RNA, 1755 nt, Artificial Sequence
  hemagglutinin__InfluenzaB__AGX23556
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuugggguuuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugccguagacauaggaaauggaugcuucgaaaccaaacacaaaugcaaccagaccugcuuagacaggauagcugcuggcaccuuuaaugcaggagaauuuucucuccccacuuuugauucauuaaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucauguuccaucugucuauaa

SEQ ID NO: 58184 - RNA, 1755 nt, Artificial Sequence
  hemagglutinin__InfluenzaB__AGX23567
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuuugcaacaauggcuugggcugucccaaaggacaacaacaaaaacgcaacgaacccacuaacaguagaaguaccauacauuuguacagaaggggaagaccaaauuacuguuuggggauuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaauaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacugaagaaaaugcugggucccucugcuguagacauaggaaauggaugcuucgaaaccaaacacaaaugcaaccagaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58185 - RNA, 1755 nt, Artificial Sequence; identical to SEQ ID NO: 57546
  hemagglutinin__InfluenzaB__AGX23578

SEQ ID NO: 58186 - RNA, 1755 nt, Artificial Sequence
  hemagglutinin__InfluenzaB__AGX23600
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagaggaaaacuaugcccagacugucucaacuguacagaucuggauguggccuugggcagaccaauguguguggggaccacaccuucugcaaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuucauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcgcauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58187 - RNA, 1755 nt, Artificial Sequence
  hemagglutinin__InfluenzaB__AGX23611
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaauuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaucaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaucuuaagaguacacaagaagcuauaaacaagauaacaaaaaaucucaacucuuugagugagcuagaaauaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugccguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58188 - RNA, 1755 nt, Artificial Sequence; identical to SEQ ID NO: 57546
  hemagglutinin__InfluenzaB__AGX23622

SEQ ID NO: 58189 - RNA, 1755 nt, Artificial Sequence
  hemagglutinin__InfluenzaB__AGX23633
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugagaauaucagguuaucaacccaaaacguuaucgaugcagaaaaggcaccgggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58190 - RNA, 1755 nt, Artificial Sequence; identical to SEQ ID NO: 57548
  hemagglutinin__InfluenzaB__AGX23644

SEQ ID NO: 58191 - RNA, 1755 nt, Artificial Sequence; identical to SEQ ID NO: 57547
  hemagglutinin__InfluenzaB__AGX23655

SEQ ID NO: 58192 - RNA, 1755 nt, Artificial Sequence; identical to SEQ ID NO: 57548
  hemagglutinin__InfluenzaB__AGX23666

SEQ ID NO: 58193 - RNA, 1755 nt, Artificial Sequence
  hemagglutinin__InfluenzaB__AGX23677
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucuuagaggauaugaaaagaucagguuaucaacucaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguauagaaggggaagaccaaauuacuguuuggggguuccauucagauaauaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaucauacuauacugcucuauuacucaacugcugcuucuaguuuggcuguaacauugaugcuagcuauuuucauuguuuauauggucuccagagacaacguuucaugcuccaucugucuauaa

SEQ ID NO: 58194 - RNA, 1755 nt, Artificial Sequence; identical to SEQ ID NO: 57548
  hemagglutinin__InfluenzaB__AGX23688

SEQ ID NO: 58195 - RNA, 1755 nt, Artificial Sequence
  hemagglutinin__InfluenzaB__AGX23699
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguagccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccgggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58196 - RNA, 1755 nt, Artificial Sequence; identical to SEQ ID NO: 57546
  hemagglutinin__InfluenzaB__AGX23710

SEQ ID NO: 58197 - RNA, 1755 nt, Artificial Sequence; identical to SEQ ID NO: 57548
  hemagglutinin__InfluenzaB__AGX23721

SEQ ID NO: 58198 - RNA, 1755 nt, Artificial Sequence
  hemagglutinin__InfluenzaB__AGX23732
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggauuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaauaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacugaagaaaaugcugggucccucugcuguagacauaggaaauggaugcuucgaaaccaaacacaaaugcaaccaaaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58199 - RNA, 1755 nt, Artificial Sequence; identical to SEQ ID NO: 57548
  hemagglutinin__InfluenzaB__AGX23743

SEQ ID NO: 58200 - RNA, 1755 nt, Artificial Sequence
  hemagglutinin__InfluenzaB__AGX23754
augaaggcaauaauuguacuacucaugguaguaacauccaaugcagaucgaaucugcacugggauaacaucuucaaacucaccccauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaauaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58201 - RNA, 1755 nt, Artificial Sequence; identical to SEQ ID NO: 57546
  hemagglutinin__InfluenzaB__AGX23765

SEQ ID NO: 58202 - RNA, 1755 nt, Artificial Sequence
  hemagglutinin__InfluenzaB__AGX23776
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccgggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucccagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58203 - RNA, 1755 nt, Artificial Sequence
  hemagglutinin__InfluenzaB__AGX23787
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccgggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaagugaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58204 - RNA, 1755 nt, Artificial Sequence; identical to SEQ ID NO: 58198
  hemagglutinin__InfluenzaB__AGX23798

SEQ ID NO: 58205 - RNA, 1755 nt, Artificial Sequence; identical to SEQ ID NO: 58184
  hemagglutinin__InfluenzaB__AGX23809

SEQ ID NO: 58206 - RNA, 1755 nt, Artificial Sequence; identical to SEQ ID NO: 58198
  hemagglutinin__InfluenzaB__AGX23820

SEQ ID NO: 58207 - RNA, 1755 nt, Artificial Sequence
  hemagglutinin__InfluenzaB__AGX23831
augaaggcaauaauuguacuacucaugguaguaacauccaaugcagaucgaaucugcacugggauaacaucuucaaacucaccucauguggucaaaacagcuacucaaggggaagucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccgggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58208 - RNA, 1755 nt, Artificial Sequence; identical to SEQ ID NO: 58198
  hemagglutinin__InfluenzaB__AGX23842

SEQ ID NO: 58209 - RNA, 1755 nt, Artificial Sequence
  hemagglutinin__InfluenzaB__AGX23853
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaauccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagaucggcggcuucccagaucaaacagaagacggaggacuaccacaaagcggcagaauugucguugauuacaugaugcaaaaaucugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58210 - RNA, 1755 nt, Artificial Sequence
  hemagglutinin__InfluenzaB__AGX23864
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggauuccauucagauaacaaaacccaaaugaagaaccucuauggagacucaaauccucaaaaguucaccucaucugcuaauggaguaaccacacauuauguuucccagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaauaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacugaagaaaaugcugggucccucugcuguagacauaggaaauggaugcuucgaaaccaaacacaaaugcaaccagaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58211 - RNA, 1755 nt, Artificial Sequence; identical to SEQ ID NO: 57548
  hemagglutinin__InfluenzaB__AGX23875

SEQ ID NO: 58212 - RNA, 1755 nt, Artificial Sequence
  hemagglutinin__InfluenzaB__AGX23886
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuuugcaacaauggcuugggcugucccaaaggacaacaacaaaaacgcaacgaacccacuaacaguagaaguaccauacauuuguacagaaggggaagaccaaauuacuguuuggggauuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaauaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugaaagaaaacugaagaaaaugcugggucccucugcuguagacauaggaaauggaugcuucgaaaccaaacacaaaugcaaccagaccugcuuagacaggauagcugcuggcaccuuuaaugcaggagaauuuucucucccuacuuuugauucauugaacauuacugcugcaucuuuaaaugaugauggauuggauaaccacacuauacugcucuauuacucaacugccgcuucuaguuuggcuguaacauugaugcuagccauuuuuauuguuuauauggucuccagagacaacguuucaugcuccaucugucuauaa

SEQ ID NO: 58213 - RNA, 1755 nt, Artificial Sequence
  hemagglutinin__InfluenzaB__AGX23897
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagaucggcggcuucccagaucaaacagaagacggaggacuaccacaaagcggcagaauugucguugauuacaugaugcaaaaaucugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58214 - RNA, 1755 nt, Artificial Sequence
  hemagglutinin__InfluenzaB__AGX23908
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucguaacaauggcuugggcugucccaaaggacaacaacaaaaacgcaacgaacccacuaacaguagaaguaccauacauuuguacagaaggggaagaccaaauuacuguuuggggauuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaauaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacugaagaaaaugcugggucccucugcuguagacauaggaaauggaugcuucgaaaccaaacacaaaugcaaccaaaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58215 - RNA, 1755 nt, Artificial Sequence
  hemagglutinin__InfluenzaB__AGX23919
augaaggcaauaauuguacuacucaugguaguaacauccaaugcagaucgaauaugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacuggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugcuauggaugaacuccacaacgaaauacucgagcuggaugagaaaguggaugaucucagagcugacacuauaagcucgcaaauagaacuugcagucuugcuuuccaacgaaggaauaauaaacagugaagaugagcauuuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58216 - RNA, 1755 nt, Artificial Sequence
  hemagglutinin__InfluenzaB__AGX23930
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58217 - RNA, 1755 nt, Artificial Sequence
  hemagglutinin__InfluenzaB__AGX23941
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggauuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaauaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacugaagaaaaugcugggucccucugcuguagacauaggaaauggaugcuucgaaaccaaacacaaaugcaaccagaccugcuuagacaggauagcugcuggcaccuuuaaugcaggagaauucucucucccuacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58218 - RNA, 1755 nt, Artificial Sequence
  hemagglutinin__InfluenzaB__AGX23952
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccgggaggacccuacagacuuggaaccucaggaucuugcccuaacgcuaccaguaaaaguggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58219 - RNA, 1755 nt, Artificial Sequence
  hemagglutinin__InfluenzaB__AGX23963
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaagcaccgggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58220 - RNA, 1755 nt, Artificial Sequence
  hemagglutinin__InfluenzaB__AGX23974
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcgggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58221 - RNA, 1755 nt, Artificial Sequence
  hemagglutinin__InfluenzaB__AGX23985
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaaaguguggugcgcgaguggcaggagcaaaguaauaaaaggguccuugccuuuaauuggugaagcagauugccuucaugaaaaauacgguggauuaaacaaaagcaagccuuacuacacuggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugcuauggaugaacuccacaacgaaauacucgagcuggaugagaaaguggaugaucucagagcugacacuauaagcucgcaaauagaacuugcagucuugcuuuccaacgaaggaauaauaaacagugaagaugagcauuuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58222 - RNA, 1755 nt, Artificial Sequence
  hemagglutinin__InfluenzaB__AGX23996
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuauuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggauuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccuggaaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaauaaaagcaagccuuacuacacaggagaacaugcaaaggccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacugaagaaaaugcugggucccucugcuguagacauaggaaauggaugcuucgaaaccaaacacaaaugcaaccagaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58223 - RNA, 1755 nt, Artificial Sequence; identical to SEQ ID NO: 58216
  hemagglutinin__InfluenzaB__AGX24007

SEQ ID NO: 58224 - RNA, 1755 nt, Artificial Sequence
  hemagglutinin__InfluenzaB__AGX24018
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaagugauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58225 - RNA, 1755 nt, Artificial Sequence
  hemagglutinin__InfluenzaB__AGX24029
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguaaagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacuggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugcuauggaugaacuccacaacgaaauacucgagcuggaugaaaaaguggaugaucucagagcugacacuauaagcucgcaaauagaacuugcagucuugcuuuccaacgaaggaauaauaaacagugaagaugagcauuuauuggcacuugagagaaaacuaaagaaaaugcugggucccucugcuguagagauaggaaauggaugcuucgaaaccaaacacaagugcaaccagaccugcuuaaacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58226 - RNA, 1755 nt, Artificial Sequence
  hemagglutinin__InfluenzaB__AGX24040
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaagugauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaucuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58227 - RNA, 1755 nt, Artificial Sequence
  hemagglutinin__InfluenzaB__AGX24051
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagauuuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccgggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauacagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuuugaaaccaaacacaaaugcaaccagaccugcuuagacaggauagcugcuggcaccuuuaaugcaggagaguuuucucuccccacuuuugauucauuaaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58228 - RNA, 1755 nt, Artificial Sequence
  hemagglutinin__InfluenzaB__AGX24062
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaggcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58229 - RNA, 1755 nt, Artificial Sequence
  hemagglutinin__InfluenzaB__AGX24073
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacuggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugcuauggaugaacuccacaacgaaauacucgagcuggaugagaaaguggaugaucucagagcugacacuauaagcucgcaaauagaacuugcagucuugcuuuccaacgaaggaauaauaaacagugaagaugagcauuuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58230 - RNA, 1755 nt, Artificial Sequence
  hemagglutinin__InfluenzaB__AGX24084
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauaauccacgaagucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggauuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaauaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacugaagaaaaugcugggucccucugcuguagacauaggaaauggaugcuucgaaaccaaacacaaaugcaaccagaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58231 - RNA, 1755 nt, Artificial Sequence
  hemagglutinin__InfluenzaB__AGX24095
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucauccgcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuucuaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58232 - RNA, 1755 nt, Artificial Sequence
  hemagglutinin__InfluenzaB__AGX24106
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaagucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacacuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggauuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaauaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccauaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacugaagaaaaugcugggucccucugcuguagacauaggaaauggaugcuucgaaaccaaacacaaaugcaaccaaaccugcuuagacaggauagcugcuggcaccuuuaaugcaggagaauuuucucucccuacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58233 - RNA, 1755 nt, Artificial Sequence
  hemagglutinin__InfluenzaB__AGX24117
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacacuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaagugauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaucuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58234 - RNA, 1755 nt, Artificial Sequence
  hemagglutinin__InfluenzaB__AGX24128
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagacccguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugcauucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58235 - RNA, 1755 nt, Artificial Sequence
  hemagglutinin__InfluenzaB__AGX24139
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuagcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggggaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58236 - RNA, 1755 nt, Artificial Sequence
  hemagglutinin__InfluenzaB__AGX24150
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccauacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58237 - RNA, 1755 nt, Artificial Sequence
  hemagglutinin__InfluenzaB__AGX24161
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggacgagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58238 - RNA, 1755 nt, Artificial Sequence
  hemagglutinin__InfluenzaB__AGX24172
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaagcuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58239 - RNA, 1755 nt, Artificial Sequence
  hemagglutinin__InfluenzaB__AGX24183
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucaaauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58240 - RNA, 1755 nt, Artificial Sequence
  hemagglutinin__InfluenzaB__AGX24194
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuggaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58241 - RNA, 1755 nt, Artificial Sequence
  hemagglutinin__InfluenzaB__AGX24205
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagagcacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58242 - RNA, 1755 nt, Artificial Sequence
  hemagglutinin__InfluenzaB__AGX24227
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaucuagauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggacgagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgagaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugauguuggcuauuuuuauuguuuauauggucuccagagacaacguuucaugcuccaucugucuauaa

SEQ ID NO: 58243 - RNA, 1755 nt, Artificial Sequence
  hemagglutinin__InfluenzaB__AGX24238
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcagaagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58244 - RNA, 1755 nt, Artificial Sequence
  hemagglutinin__InfluenzaB__AGX24249
augaaggcaauaauuguacuacucaugguaguaacauccaaugcagaucgaaucugcacugggauaacaucuucaaaaucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguagcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58245 - RNA, 1755 nt, Artificial Sequence
  hemagglutinin__InfluenzaB__AGX24260
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagccucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58246 - RNA, 1755 nt, Artificial Sequence; identical to SEQ ID NO: 57821
  hemagglutinin__InfluenzaB__AGX24271

SEQ ID NO: 58247 - RNA, 1755 nt, Artificial Sequence
  hemagglutinin__InfluenzaB__AGX24282
augaaggcaauaauuguacuacucaugguaguaacauccaaugcagaucgaaucugcacuggaauaacauccucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacaaaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaggguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58248 - RNA, 1755 nt, Artificial Sequence
  hemagglutinin__InfluenzaB__AGX24293
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagccucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaagcuauuaaaggaaagggguuucuucggagcuauugcugguuuccuagaaggaggaugggaaggaaugauugcaggcuggcacggauacacaucucacggagcacauggaguggcaguggcggcggaccuuaagagcacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58249 - RNA, 1755 nt, Artificial Sequence
  hemagglutinin__InfluenzaB__AGX24304
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucccacggagcacauggaguggcaguggcggcggaccuuaagaguacgcaagaagcuauaaacaagauaacaaaaaaucucaauucuuugagugagcuagaaguaaagaaucuucaaagacuaaguggugcuauggaugaacuccacaacgaaauacucgagcuggaugagaaaguggaugaucucagagcugacacuauaagcucgcaaauagaacuugcagucuugcuuuccaacgaaggaauaauaaacagugaagaugagcauuuauuggcacuugagagaaaauuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58250 - RNA, 1755 nt, Artificial Sequence; identical to SEQ ID NO: 57821
  hemagglutinin__InfluenzaB__AGX24315

SEQ ID NO: 58251 - RNA, 1755 nt, Artificial Sequence
  hemagglutinin__InfluenzaB__AGX24326
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaacguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58252 - RNA, 1755 nt, Artificial Sequence
  hemagglutinin__InfluenzaB__AGX24337
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaugccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58253 - RNA, 1755 nt, Artificial Sequence; identical to SEQ ID NO: 57555
  hemagglutinin__InfluenzaB__AGX24348

SEQ ID NO: 58254 - RNA, 1755 nt, Artificial Sequence; identical to SEQ ID NO: 58248
  hemagglutinin__InfluenzaB__AGX24359

SEQ ID NO: 58255 - RNA, 1755 nt, Artificial Sequence
  hemagglutinin__InfluenzaB__AGX24381
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguagcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58256 - RNA, 1755 nt, Artificial Sequence
  hemagglutinin__InfluenzaB__AGX24392
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggacuacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuuguccuaacgcuaccaguaagagcggauuuuucgcaacaauggcuugggcugucccaaaggacaacaacaaaaaugcaacgaacccacuaacaguagaaauaccauacauuuguacagaaggggaagaccaaaucacuguuuggggguuccauucagacaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacgccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58257 - RNA, 1755 nt, Artificial Sequence
  hemagglutinin__InfluenzaB__AGX24403
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaagaaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacaaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccuggaaaaacaggaacaauuguuuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucccacggagcacauggaguggcaguggcggcggaccuuaagaguacgcaagaagcuauaaacaagauaacaaaaaaucucaauucuuugagugagcuagaaguaaagaaucuucaaagacuaaguggugcuauggaugaacuccacaacgaaauacucgagcuggaugagaaaguggaugaucucagagcugacacuauaagcucgcaaauagaacuugcagucuugcuuuccaacgaaggaauaauaaacagugaagaugagcauuuauuggcacuugagagaaaauuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58258 - RNA, 1755 nt, Artificial Sequence
  hemagglutinin__InfluenzaB__AGX24414
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucagacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcucauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58259 - RNA, 1755 nt, Artificial Sequence
  hemagglutinin__InfluenzaB__AGX24425
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaauuaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcaaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaagcuauuaaaggaaagggguuucuucggagcuauugcugguuuccuagaaggaggaugggaaggaaugauugcaggcuggcacggauacacaucucacggagcacauggaguggcaguggcggcggaccuuaagagcacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58260 - RNA, 1755 nt, Artificial Sequence
  hemagglutinin__InfluenzaB__AGX24436
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucccauggagcacauggaguggcaguggcggcggaccuuaagaguacgcaagaagcuauaaacaagauaacaaaaaaucucaauucuuugagugagcuagaaguaaagaaucuucaaagacuaaguggugcuauggaugaacuccacaacgaaauacucgagcuggaugagaaaguggaugaucucagagcugacacuauaagcucgcaaauagaacuugcagucuugcuuuccaacgaaggaauaauaaacagugaagaugagcauuuauuggcacuugagagaaaauuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58261 - RNA, 1755 nt, Artificial Sequence
  hemagglutinin__InfluenzaB__AGX24447
augaaggcaauaauuguacuacucaugguaguaacauccaaugcagaucgaaucugcacuggaauaacauccucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaggguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggggcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58262 - RNA, 1755 nt, Artificial Sequence
  hemagglutinin__InfluenzaB__AGX24458
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggacguggcuuugggcagaccaacguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcauggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58263 - RNA, 1755 nt, Artificial Sequence
  hemagglutinin__InfluenzaB__AGX24469
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaacguguguggggaccacaccuucggcgaaagcuucaauacuccacgaagucagaccuguuacauccgggugcuuuccuauaaugcacgacagaacaaaaaucagacaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugguugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58264 - RNA, 1755 nt, Artificial Sequence; identical to SEQ ID NO: 57821
  hemagglutinin__InfluenzaB__AGX24480

SEQ ID NO: 58265 - RNA, 1755 nt, Artificial Sequence; identical to SEQ ID NO: 57821
  hemagglutinin__InfluenzaB__AGX24491

SEQ ID NO: 58266 - RNA, 1755 nt, Artificial Sequence
  hemagglutinin__InfluenzaB__AGX24502
augaaggcaauaauuguacuacucaugguaguaacauccaaugcagaucgaaucugcacuggaauaacauccucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcagaaaaggcaccaggaggacccuacagacuuggaaccucaggaucuugcccuaacgcuaccaguaagagcggauuuuucgcaacaauggcuugggcuguccaaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaggguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58267 - RNA, 1755 nt, Artificial Sequence
  hemagglutinin__InfluenzaB__AGX24513
augaaggcaauaauuguacuacucaugguaguaacauccaaugcagaucgaaucugcaccgggauaacaucuucaaacucaccucauguggucaaaacagcuacucaaggggaggucaaugugacuggugugauaccacugacaacaacaccaacaaaaucuuauuuugcaaaucucaaaggaacaaagaccagagggaaacuaugcccagacugucucaacuguacagaccuggauguggccuugggcaggccaaugugugugggaaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaaguggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58268 - RNA, 1755 nt, Artificial Sequence
  hemagglutinin__InfluenzaB__AGX24524
augaaggcaauaauuguacuacucaugguaguaacauccaaugcagaucgaaucugcacuggaauaacauccucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaauccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaggguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58269 - RNA, 1755 nt, Artificial Sequence
  hemagglutinin__InfluenzaB__AGX24535
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaaucggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcgcacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58270 - RNA, 1755 nt, Artificial Sequence; identical to SEQ ID NO: 58241
  hemagglutinin__InfluenzaB__AGX24546

SEQ ID NO: 58271 - RNA, 1755 nt, Artificial Sequence
  hemagglutinin__InfluenzaB__AGX24557
augaagacaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuugauguggcuuugggcagaccaacguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugaaaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58272 - RNA, 1755 nt, Artificial Sequence; identical to SEQ ID NO: 57821
  hemagglutinin__InfluenzaB__AGX24579

SEQ ID NO: 58273 - RNA, 1755 nt, Artificial Sequence; identical to SEQ ID NO: 57821
  hemagglutinin__InfluenzaB__AGX24590

SEQ ID NO: 58274 - RNA, 1755 nt, Artificial Sequence
  hemagglutinin__InfluenzaB__AGX24601
augaaggcaauaauuguacuacucaugguaguaacauccaaugcagaucgaaucugcacuggaauaacauccucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaggguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguugaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuucaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58275 - RNA, 1755 nt, Artificial Sequence; identical to SEQ ID NO: 57821
  hemagglutinin__InfluenzaB__AGX24612

SEQ ID NO: 58276 - RNA, 1755 nt, Artificial Sequence; identical to SEQ ID NO: 58248
  hemagglutinin__InfluenzaB__AGX24623

SEQ ID NO: 58277 - RNA, 1755 nt, Artificial Sequence; identical to SEQ ID NO: 57821
  hemagglutinin__InfluenzaB__AGX24634

SEQ ID NO: 58278 - RNA, 1755 nt, Artificial Sequence
  hemagglutinin__InfluenzaB__AGX24656
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggugacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcgcacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58279 - RNA, 1755 nt, Artificial Sequence
  hemagglutinin__InfluenzaB__AGX24667
augaaggcaauaauuguacuacucaugguaguaacauccaaugcagaucgaaucugcacgggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcagaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuucaaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58280 - RNA, 1755 nt, Artificial Sequence
  hemagglutinin__InfluenzaB__AGX24678
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58281 - RNA, 1755 nt, Artificial Sequence; identical to SEQ ID NO: 57821
  hemagglutinin__InfluenzaB__AGX24689

SEQ ID NO: 58282 - RNA, 1755 nt, Artificial Sequence; identical to SEQ ID NO: 57821
  hemagglutinin__InfluenzaB__AGX24700

SEQ ID NO: 58283 - RNA, 1755 nt, Artificial Sequence; identical to SEQ ID NO: 57821
  hemagglutinin__InfluenzaB__AGX24711

SEQ ID NO: 58284 - RNA, 1755 nt, Artificial Sequence
  hemagglutinin__InfluenzaB__AGX24722
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucuucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucccuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58285 - RNA, 1755 nt, Artificial Sequence
  hemagglutinin__InfluenzaB__AGX24733
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucccacggagcacauggaguggcaguggcggcggaccuuaagaguacgcaagaagcuauaaacaagauaacaaaaaaucucaauucuuugagugagcuagaaguaaagaaucuucaaagacuaaguggugcuauggaugaacuccacaacgaaauacucgagcuggaugagaaaguggaugaucucagagcugacacuauaagcucgcaaauagaacuugcagucuugcuuuccaacgaaggaauaauaaacagugaagaugagcauuuauuggcacuugagagaaaauuaaagaaaaugcugggucccucugcuguagagauaggaaauggaugcuuugaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58286 - RNA, 1755 nt, Artificial Sequence
  hemagglutinin__InfluenzaB__AGX24744
augaaggcaauaauuguacuacucaugguaguaacauccaaugcagaucgaaucugcaccggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucuucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagaggaaacuaaagaaaaugcugggucccucugcuguagagauaggaaauggaugcuucgaaaccaaacacaagugcaaccagaccugcuuagacaggauagcugcuggcaccuuuaaugcaggagaauuuucccuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58287 - RNA, 1755 nt, Artificial Sequence
  hemagglutinin__InfluenzaB__AGX24755
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcagaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58288 - RNA, 1755 nt, Artificial Sequence; identical to SEQ ID NO: 57821
  hemagglutinin__InfluenzaB__AGX24766

SEQ ID NO: 58289 - RNA, 1755 nt, Artificial Sequence; identical to SEQ ID NO: 58284
  hemagglutinin__InfluenzaB__AGX24777

SEQ ID NO: 58290 - RNA, 1755 nt, Artificial Sequence
  hemagglutinin__InfluenzaB__AGX24788
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaagcuauuaaaggaaagggguuucuucggagcuauugcugguuuccuagaaggaggaugggaaggaaugauugcaggcuggcacggauacacaucucacggagcacauggaguggcaguggcggcggaccuuaagagcacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58291 - RNA, 1755 nt, Artificial Sequence; identical to SEQ ID NO: 58248
  hemagglutinin__InfluenzaB__AGX24799

SEQ ID NO: 58292 - RNA, 1755 nt, Artificial Sequence; identical to SEQ ID NO: 57821
  hemagglutinin__InfluenzaB__AGX24810

SEQ ID NO: 58293 - RNA, 1755 nt, Artificial Sequence; identical to SEQ ID NO: 57821
  hemagglutinin__InfluenzaB__AGX24821

SEQ ID NO: 58294 - RNA, 1755 nt, Artificial Sequence
  hemagglutinin__InfluenzaB__AGX24832
augaaggcaauaauuguacuacucaugguaguaacauccaaugcagaucgaaucugcacuggaauaacauccucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguauuuuguugccucaaaggguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58295 - RNA, 1755 nt, Artificial Sequence
  hemagglutinin__InfluenzaB__AGX24843
augaaagcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccgauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacugggaaccucaggaucuugccccaacgcuaccaguaaaaucggauuuuucgcaacaauggcuugggcugucccaaaggacaacuacaaaaaugcaacgaacccacuaacaguagaagugccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguuaccucaaaggguguggugcacgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaucuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58296 - RNA, 1755 nt, Artificial Sequence
  hemagglutinin__InfluenzaB__AGX24854
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuauguccggaaugucucaacuguacagaucuggauguggccuugggcaggccaauguguguggggaccacaccuucugcuaaagcuucaauacuccacgaagucagaccuguuacauccgggugcuuuccuauaaugcaugacagaacaaaaaucaggcaacuacccaaucuucucagaggauaugaaaauaucagguuaucaacccaaaacguuaucgaugcagaaaaagcaccaggaggaccuuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuugugcagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuuuccagaucaaacagaagacggaggacuaccacaaagcggcagaauuguuguugauuacauggugcaaagaccugggaaaacaggaacaauugucuaucaaagaggcguuuuguugccucaaaagguguggugcgcgaguggcaggagcaaaguaauaaaagggucauugccuuuaauuggugaagcagauugucuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacacggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcgucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58297 - RNA, 1755 nt, Artificial Sequence
  hemagglutinin__InfluenzaB__AGX24865
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuauguccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggaccuuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuugugcagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuuuccagaucaaacagaagacggaggacuaccacaaagcggcagaauuguuguugauuacauggugcaaagaccugggaaaacaggaacaauugucuaucaaagaggcguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacacggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcgucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58298 - RNA, 1755 nt, Artificial Sequence
  hemagglutinin__InfluenzaB__AGX24876
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacucacuaacaguagaaguaccauacauuuguaaagaaggggaagaccaaauuacuguuuggggguuccauucagauaacaaaccccaaaugaagaaccucuauggagacucaaauccucaaaaguucaccucaucugcuaauggaguaaccacacauuauguuucucagguuggcgacuucccagaucaaacagaagacggaggacuaccacaaagcggcagaauuguuguugauuacaugaugcaaaaaccugggagaacaggaacaauugucuaucaaagagguguuuuguugccucaaaagguguggugcgcgaguggcaggagcaaaguaauaaaagggucauugccuuuaauuggugaagcagauugccuucaugagaaauacgguggauuaaacaaaagcaagccuuacuacacaggagaacaugcaaaagccauagggaacugcccaauauggguaaaaacaccuuugaaacuugccaaugggaccaaauauagaccuccugcaaaacuauuaaaggaaagggguuucuucggggcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58299 - RNA, 1755 nt, Artificial Sequence
  hemagglutinin__InfluenzaB__AGX24887
augaaggcaauaauuguacuacucaugguaguaacauccaaugcagaucgaaucugcacugggauaacaucuucaaacucaccucauguagucaaaacagcuacucaaggggaggucaaugugacuggcgcgauaccauugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacaaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacauggugcaaaaaccugggaaaacaggaacaauugucuaucaaagaggcguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuuaagugagcuagaaguaaaaaaccuucaaagacuaaguggugccauggaugaacuccacaacgaaauacucgagcuggaugagaaaguggaugaucucagagcugacacuaugagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58300 - RNA, 1755 nt, Artificial Sequence
  hemagglutinin__InfluenzaB__AGX24898
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaggucagaccuguuacauccgggugcuuuccuauaaugcacgacagaacaaaaaucaggcaacuacccaaucuucucagaggauaugaaaagaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguggaaguaccauacauuuguacaggaggggaagaccaaauuacuguuuggggguuccauucagauaacaaaacccaaaugaagagccucuauggagacucaaauccucaaaaguucacaucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugcccuuaauuggugaagcagauugccuucaugaaaaauaugguggauuaaacaaaagcaagccuuacuacacaggagaacaugcaaaagccauaggaaauugcccaauauggguaaaaacaccuuugaagcuugccaauggaaccaaauauagaccuccugcaaaacuauugaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaacggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58301 - RNA, 1758 nt, Artificial Sequence
  hemagglutinin__InfluenzaB__AGX84854
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuagacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaaugaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggugcuauugcuggcuucuuggaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaaugaaauacuagaauuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58302 - RNA, 1758 nt, Artificial Sequence
  hemagglutinin__InfluenzaB__AGX84865
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggagggugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagaaauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58303 - RNA, 1758 nt, Artificial Sequence
  hemagglutinin__InfluenzaB__AGX84876
augaaggcaauaauuguacuacucaugguaguaacauccaaugcagaucgaaucugcacugggauaacaucgucaaacucaccacauaucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagaaauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauaa

SEQ ID NO: 58304 - RNA, 1758 nt, Artificial Sequence; identical to SEQ ID NO: 58302
  hemagglutinin__InfluenzaB__AGX84887

SEQ ID NO: 58305 - RNA, 1758 nt, Artificial Sequence; identical to SEQ ID NO: 58301
  hemagglutinin__InfluenzaB__AGX84898

SEQ ID NO: 58306 - RNA, 1758 nt, Artificial Sequence
  hemagglutinin__InfluenzaB__AGX84920
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuggacguagccuugggcagaccaaaaugcacggggaaaauacccucggcaggaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaaccgcaacaaauccauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacacugaugauagcuaucuuuguuguuuauauggucuccagagacaauguuucuugcuccaucugucuauag

SEQ ID NO: 58307 - RNA, 1758 nt, Artificial Sequence
  hemagglutinin__InfluenzaB__AGZ59821
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugcuucaacugcacagaucuggacguggccuugggcagaccaaaaugcacggggaacauacccucggcaaaaguuucaauacuccaugaagucagaccuguuacaucugggugcuuuccuauaaugcacgacagaacaaaaguuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuuugcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58308 - RNA, 1758 nt, Artificial Sequence
  hemagglutinin__InfluenzaB__AGZ59832
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaagagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugaagauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58309 - RNA, 1758 nt, Artificial Sequence
  hemagglutinin__InfluenzaB__AGZ59843
augaaggcaauaauuguacuacucaugguaguaacauccaaugcagaucgaaucugcacugggauaacaucgucaaacucaccacauguugucaaaacugcuacucaaggggaggucaaugugaccgguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuauuguuuauauggucuccagagacaauguuucuugcuccaucugucuauaa

SEQ ID NO: 58310 - RNA, 1758 nt, Artificial Sequence
  hemagglutinin__InfluenzaB__AGZ59854
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaaaauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaacaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggagaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58311 - RNA, 1758 nt, Artificial Sequence
  hemagglutinin__InfluenzaB__AGZ59865
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaauugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacuacucuacuacucaacugcugccuccaguuuggcugucacauugaugauagcuaucuuuguuguuuauauggucuccagagacaauguuucuugcuccaucugucuauaa

SEQ ID NO: 58312 - RNA, 1758 nt, Artificial Sequence
  hemagglutinin__InfluenzaB__AGZ59876
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuuugcaacaauggcuugggcugucccaaaaaacgacaaaaacaaaacagcaacaaauucauuaacaauagaaguaccauacauuuguacagagggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcacaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaaaaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58313 - RNA, 1755 nt, Artificial Sequence
  hemagglutinin__InfluenzaB__AGZ59887
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggacuacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuuguccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacgccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaaaauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaggaugagcaucuauuggcacuugagagaaaacuaaagaaaaugcugggucccucugcuguagagauaggaaauggaugcuucgaaaccaaacacaagugcaaccagaccuguuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58314 - RNA, 1758 nt, Artificial Sequence; identical to SEQ ID NO: 57495
  hemagglutinin__InfluenzaB__AGZ59898

SEQ ID NO: 58315 - RNA, 1758 nt, Artificial Sequence
  hemagglutinin__InfluenzaB__AGZ59909
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaaugaaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58316 - RNA, 1758 nt, Artificial Sequence; identical to SEQ ID NO: 57501
  hemagglutinin__InfluenzaB__AGZ59920

SEQ ID NO: 58317 - RNA, 1758 nt, Artificial Sequence; identical to SEQ ID NO: 57495
  hemagglutinin__InfluenzaB__AGZ59931

SEQ ID NO: 58318 - RNA, 1758 nt, Artificial Sequence; identical to SEQ ID NO: 57500
  hemagglutinin__InfluenzaB__AGZ59942

SEQ ID NO: 58319 - RNA, 1758 nt, Artificial Sequence; identical to SEQ ID NO: 57493
  hemagglutinin__InfluenzaB__AGZ59953

SEQ ID NO: 58320 - RNA, 1758 nt, Artificial Sequence
  hemagglutinin__InfluenzaB__AGZ59965
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaguuguuguugauuacaugaugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58321 - RNA, 1758 nt, Artificial Sequence
  hemagglutinin__InfluenzaB__AGZ59976
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagguuaucaacucauaacguuaucaaugcagaaaaugcaccaggaggacccuacaaaauuggaaccucagggucuugcccuaacauuaccaauggaaacggauuuuuugcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagggguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58322 - RNA, 1758 nt, Artificial Sequence; identical to SEQ ID NO: 57493
  hemagglutinin__InfluenzaB__AGZ59987

SEQ ID NO: 58323 - RNA, 1758 nt, Artificial Sequence; identical to SEQ ID NO: 57501
  hemagglutinin__InfluenzaB__AGZ59999

SEQ ID NO: 58324 - RNA, 1758 nt, Artificial Sequence; identical to SEQ ID NO: 57945
  hemagglutinin__InfluenzaB__AGZ60010

SEQ ID NO: 58325 - RNA, 1758 nt, Artificial Sequence; identical to SEQ ID NO: 57887
  hemagglutinin__InfluenzaB__AGZ60021

SEQ ID NO: 58326 - RNA, 1758 nt, Artificial Sequence
  hemagglutinin__InfluenzaB__AGZ60033
augaaggcaauaauuguacuacucaugguaguaacauccaaugcagaucgaaucugcacugggauaacaucgucaaacucaccacaugucgucaaaacugcuacucaaggggaggucaaugugacugguguaauaccacugacaacaacacccaccaaaucucauuuugcaaaucucaaaggaacagaaaccagagggaaacuaugcccaaaaugccccaacugcacagaucuagacguagccuugggcagaccaaaaugcacggggaaaauacccucggcaagaguuucaauacuccaugaagucagaccuguuacaucugggugcuuuccuauaaugcacgacagaacaaaaauuagacagcugccuaaccuucuccgaggauacgaacauaucagauuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaaaaacaaaacagcaacaaauccauuaacaauagaaguaccauacauuuguacagaaggagaagaccaaauuaccguuuggggguuccacucugauaacgagacccaaauggcaaagcucuauggggacucaaagccccagaaguuuaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaagacacccuugaagcuggccaauggaaccaaauauagaccuccugcaaaacuauuaaaggaaagggguuucuucggagcuauugcugguuucuuagaaggaggaugggaaggaaugauugcagguuggcacggauacacgucccauggggcacauggaguagcgguggcagcagaccuuaagagcacucaagaggccauaaacaagauaacaaaaaaucucaacucuuugagugagcuggaaguaaagaaucuucaaagacuaaguggugccauggaugaacuccacaacgaaauacuagaacuagacgagaaaguggaugaucucagagcugauacaauaagcucacaaauagaacucgcaguccugcuuuccaaugaaggaauaauaaacagugaagaugaacaucucuuggcacuugaaagaaagcugaagaaaaugcugggcccuucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauaccauacugcuuuacuacucaacugcugccuccaguuuggcuguaacgcugaugauagccaucuuuguuguuuauauggucuccagagacaauguuucuugcuccaucugucuauaa

SEQ ID NO: 58327 - RNA, 1755 nt, Artificial Sequence
  hemagglutinin__InfluenzaB__AGZ60044
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuagauguggccuugggcagaccaauguguguggggaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauucuucgcaacaauggcuugggcugucccaaaggacaacaacaaaaaugcaacgaacccacuaacaguagaaguaccauacguuuguacggaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugagcuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58328 - RNA, 1755 nt, Artificial Sequence
  hemagglutinin__InfluenzaB__AGZ60055
augaaggcaauaauuguacuacucaugguaguaacauccaaugcagaucgaaucugcacugggauaacaucuucaaacucaccucauguggucaaaacagcuacucaaggggaggucaaugugacugguguaauaccacugacaacaacaccaacaaaaucuuauuuugcaaaucucaaaggaacaaggaccagagggaaacuauguccagacugucucaacuguacagaucuagauguggccuugggcagaccaaugugugugggaaccacaccuucggcaaaagcuucaauacuccacgaagucagaccuguuacauccgggugcuuuccuauaaugcacgacagaacaaaaaucagacaacuacccaaucuucucagaggauaugaaaauaucagauuaucaacccaaaacguuaucgaugcagaaaaugcaccaggaggacccuacagacuuggaaccucaggaucuugcccuaacgcuaccaguaaaagcggauucuucgcgacaauggcuugggcugucccaaaggacaacaacaaaaaugcaacgaacccacuaacaguagaaguaccauacguuuguacggaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaauaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58329 - RNA, 1755 nt, Artificial Sequence
  hemagglutinin__InfluenzaB__AGZ60066
augaaggcaauaauuguacuacucaugguaguaacauccaacgcagaucgaaucugcacugggauaacaucuucaaacucaccucauguggucaaaacagccacucaaggggaggucaaugugacuggugugauaccacugacaacaacuccaacaaaaucucauuuugcaaaucucaaaggaacaaggacuagagggaaacuaugcccagauugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcacuaggaggaccauacagacuuggaaccucaggaucuugcccuaacgcuaccagcaaaagcggauuuuucgcaacaauggccugggcugucccaaaggacaacaacaaaaaugcaacgaacccacuaacaguagaaguaccauacaucuguacagaaggggaagaccaaauuacuguuuggggguuccauucagauaacaaaacucaaaugaaaaaccucuauggagacucaaauccucagaaguucaccucaucugcuaauggaguaaccacacauuauguuucucagauuggcggcuuuccagaucaaacagaagacggaggacuaccacaaagcggcagaauuguuguugauuacauggugcaaaaaccugggaaaacaggaacaauugucuaucaaagagguguuuuguugccucaaaagguguggugcgcaaguggcaggagcaaaguaauaaaaggguccuugccuuuaauuggugaagcagauugccuucaugaaaaauacgguggguuaaacaaaagcaagccuuacuacacaggagaacaugcaaaagccauaggaaauugcccaauaugggugaaaacaccuuugaagcuugccaauggaaccaaauauagaccuccugcaaaacuacuaaaggaaagggguuucuucggagcuauugcugguuuccuagaaggaggaugggaaggaaugauugcagguuggcacggauacacaucccacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuucacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauauugcucuauuacucaacugcugcuucuaguuuggcuguaacauugaugcuagcuauuuuuauuguuuauauggucuccagagacaacguuucaugcuccaucugucuauaa

SEQ ID NO: 58330 - RNA, 1755 nt, Artificial Sequence
  hemagglutinin__InfluenzaB__AGZ60077
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaccucaaaggaacaaggaccagagggaaacuaugcccagacugucucaacuguacagaucuggauguggccuugggcagcccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaucugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaggcuauaaacaagauaacaaaaaaucucaauucuuugagugagcuagaaguaaagaaucuucaaagacuaaguggugccauggaugaacuccacagcgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58331 - RNA, 1755 nt, Artificial Sequence; identical to SEQ ID NO: 57548
  hemagglutinin__InfluenzaB__AGZ60088

SEQ ID NO: 58332 - RNA, 1755 nt, Artificial Sequence; identical to SEQ ID NO: 57546
  hemagglutinin__InfluenzaB__AGZ60099

SEQ ID NO: 58333 - RNA, 1755 nt, Artificial Sequence
  hemagglutinin__InfluenzaB__AGZ60131
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuauuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaaaguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugaacaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58334 - RNA, 1755 nt, Artificial Sequence; identical to SEQ ID NO: 57548
  hemagglutinin__InfluenzaB__AGZ60142

SEQ ID NO: 58335 - RNA, 1755 nt, Artificial Sequence
  hemagglutinin__InfluenzaB__AGZ60160
augaaggcaauaauuguacuacucaugguaguaacauccaaugcagaucgaaucugcacugggauaacaucuucaaacucaccucauguggucaaaacagcuacucaaggggaagucaaugugacuggugugauaccacugacaacaacaccaacaaaaucuuauuuugcaaaucucaaaggaacaaagaccagagggaaacuaugcccagacugucucaacuguacagaucuggauguggccuugggcaggccaaugugugugggaaccacaccuucugcgaaagcuucaauacuccacgaagucagaccuguuacauccgggugcuuuccuauaaugcacgacagaacaaagaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuuugcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagcccuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggguacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaguuuucccuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58336 - RNA, 1755 nt, Artificial Sequence
  hemagglutinin__InfluenzaB__AGZ60172
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaaugggguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58337 - RNA, 1755 nt, Artificial Sequence
  hemagglutinin__InfluenzaB__AGZ60183
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaagugauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58338 - RNA, 1755 nt, Artificial Sequence
  hemagglutinin__InfluenzaB__AGZ60194
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucaaauuggcgacuucccagaucaaacagaagacggaggacuaccacaaagcggcagaauuguuguugauuacaugaugcaaaaaacugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58339 - RNA, 1755 nt, Artificial Sequence
  hemagglutinin__InfluenzaB__AGZ60206
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaauaaaaucuuauuuugcaaaccucaaaggaacaaggaccagagggaaacuaugcccggauugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaacccgggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58340 - RNA, 1755 nt, Artificial Sequence; identical to SEQ ID NO: 58269
  hemagglutinin__InfluenzaB__AGZ60217

SEQ ID NO: 58341 - RNA, 1755 nt, Artificial Sequence
  hemagglutinin__InfluenzaB__AGZ60268
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaagggacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagaucggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuacuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaacucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuauagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 58342 - RNA, 1755 nt, Artificial Sequence; identical to SEQ ID NO: 57444
  hemagglutinin__InfluenzaB__AHE37993

SEQ ID NO: 58343 - RNA, 1755 nt, Artificial Sequence; identical to SEQ ID NO: 57435
  hemagglutinin__InfluenzaB__AHE37994

SEQ ID NO: 58344 - RNA, 1755 nt, Artificial Sequence
  hemagglutinin__InfluenzaB__AHE37995
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuauugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcaguaacauugaugcuagcuauuuuuauuguuuauauggucuccagagacaacguuucaugcuccaucugucuauaa

SEQ ID NO: 58345 - RNA, 1755 nt, Artificial Sequence; identical to SEQ ID NO: 57359
  hemagglutinin__InfluenzaB__AHE37996

SEQ ID NO: 58346 - RNA, 1755 nt, Artificial Sequence; identical to SEQ ID NO: 57422
  hemagglutinin__InfluenzaB__AHE37997

SEQ ID NO: 58347 - RNA, 1755 nt, Artificial Sequence
  hemagglutinin__InfluenzaB__AHE37998
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauga

SEQ ID NO: 58348 - RNA, 1755 nt, Artificial Sequence; identical to SEQ ID NO: 57425
  hemagglutinin__InfluenzaB__AHE37999

SEQ ID NO: 58349 - RNA, 1755 nt, Artificial Sequence
  hemagglutinin__InfluenzaB__AHE38000
augaaggcaauaauuguacuacucaugguaguaacauccaaugcagaccgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuauugaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugguaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 58350 - RNA, 1755 nt, Artificial Sequence; identical to SEQ ID NO: 57360
  hemagglutinin__InfluenzaB__AHE38001

SEQ ID NO: 58351 - RNA, 1755 nt, Artificial Sequence
  hemagglutinin__InfluenzaB__AHE38002
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcaaaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacaccggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58352 - RNA, 1755 nt, Artificial Sequence; identical to SEQ ID NO: 57475
  hemagglutinin__InfluenzaB__AHE38003

SEQ ID NO: 58353 - RNA, 1755 nt, Artificial Sequence; identical to SEQ ID NO: 57475
  hemagglutinin__InfluenzaB__AHE38004

SEQ ID NO: 58354 - RNA, 1755 nt, Artificial Sequence
  hemagglutinin__InfluenzaB__AHE38005
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccgacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauauaagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaagcuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58355 - RNA, 1755 nt, Artificial Sequence
  hemagglutinin__InfluenzaB__AHE38006
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggagcuacaccuucugcgaaagcuucaauacuucacgaagucagaccuguuacauccgggugcuucccuauaaugcacgacagaacaaaaaucaggcaacuagccaaucuucucaggggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuccaugaaaaauacgguggauuaaacaaaagcaagccuuacuacacaggagaacaugcaaaagccauaggaaauugcccaauaugggugaaaacaccuuuaaagcuugccaauggaaccaaauauagaccuccugcaaaacuauuaaaggaaagggguuucuucggagcuauugcugguuuccuagaagggggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccguggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuggacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58356 - RNA, 1755 nt, Artificial Sequence
  hemagglutinin__InfluenzaB__AHE38007
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccgacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauauaagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaagcuauuaaaggaaagggguuucuucggcgcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58357 - RNA, 1755 nt, Artificial Sequence
  hemagglutinin__InfluenzaB__AHE38008
augaaggcaauaauugcacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacacccucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauaccauacugcucuauuacucaacugcugcuucuaguuuggcuguaacauuaaugcuagcuauuuuuauuguuuauauggucuccagagacaacguuucaugcuccaucugucuauaa

SEQ ID NO: 58358 - RNA, 1755 nt, Artificial Sequence
  hemagglutinin__InfluenzaB__AHE38009
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucaugaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauaccauacugcucuauuacucaacugcugcuucuaguuuggcuguaacauugaugcuagcuauuuuuauuguuuauauggucuccagagacaacguuucaugcuccaucugucuauaa

SEQ ID NO: 58359 - RNA, 1755 nt, Artificial Sequence
  hemagglutinin__InfluenzaB__AHE38010
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauugcuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugucuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauaccauacugcucuauuacucaacugcugcuucuaguuuggcuguaacauugaugcuagcuauuuuuauuguuuauauggucuccagagacaacguuucaugcuccaucugucuauaa

SEQ ID NO: 58360 - RNA, 1755 nt, Artificial Sequence; identical to SEQ ID NO: 57363
  hemagglutinin__InfluenzaB__AHE38012

SEQ ID NO: 58361 - RNA, 1755 nt, Artificial Sequence
  hemagglutinin__InfluenzaB__AHE38013
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuugggcaggccaaugugugugggaacuacaccuucugcgaaagcuucaauacuucacgaagucagaccuguuacauccgggugcuucccuauaaugcacgacagaacaaagaucaggcaacuagccaaucuucucagaggauaugaaaauaucagguuaucaacccaaaauguuaucgaugcagaaaaagcaccaggaggacccuacagacuuggaaccucaggaucuugcccuaacgcuaccaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgugaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaauggcaguugcugcagaccuuaagagcacacaagaagcuauaaacaagauaacaaaaaaucucaacucguugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugccuauaa

SEQ ID NO: 58362 - RNA, 1755 nt, Artificial Sequence
  hemagglutinin__InfluenzaB__AHE38014
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaagaccagagggaaacuaugcccagacugucucaacuguacagaucuggauguggccuuaggcagaccaaugugugugggaacuacaccuucugcgaaagcuucaauacuucacgaagucagaccuguuacauccgggugcuucccuauaaugcacgacagaacaaaaaucaggcaacuagccaaucuucucagaggauaugaaaauaucagguuaucaacccaaaacguuaucgaugcagaaaaagcaccaggaggacccuacagacuuggaaccucaggaucuugcccuaacgcuacuaguaaaagcggauuuuucgcaacaauggcuugggcugucccaaaggacaacaacaaaaaugcaacgaacccauuaacaguagaaguaccauacauuugugcagaaggagaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcugcagaccuuaagagcacacaagaagcuauaaacaagauaacaaaaaaucucaacucuuugagugagcuagaaguaaagaaucuucaaaggcuaaguggugccauggaugaacuccacaacgaaauacucgagcuggaugagaaaguggaugaucucagagcugacacuauaaguucacaaauagaacuugcagucuugcuuuccaacgaaggaauaauaaacagugaagaugagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58363 - RNA, 1758 nt, Artificial Sequence
  hemagglutinin__InfluenzaB__AHE38015
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggcuacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaagugccauacauuuguacagaaggagaagaccaaauuaccguuuggggguuccacucugacaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaaaugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58364 - RNA, 1758 nt, Artificial Sequence
  hemagglutinin__InfluenzaB__AHE38016
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaauguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacaaauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaagagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccacggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacuagcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauauuauacugcuuuacuacucaacugcugcuuccaguuuggcuguaacacugaugauagcuaucuuuguuguuuauauggucuccagagacaauguuucuugcuccaucugucuauaa

SEQ ID NO: 58365 - RNA, 1758 nt, Artificial Sequence; identical to SEQ ID NO: 57468
  hemagglutinin__InfluenzaB__AHE38017

SEQ ID NO: 58366 - RNA, 1758 nt, Artificial Sequence; identical to SEQ ID NO: 57391
  hemagglutinin__InfluenzaB__AHE38018

SEQ ID NO: 58367 - RNA, 1758 nt, Artificial Sequence
  hemagglutinin__InfluenzaB__AHE38019
augaaggcaauaauuguacuacucaugguaguaacauccaaugcagaucgaaucugcacuggaauaacaucgucaaacucaccacaugucgucaaaacugcuacucaaggggaggucaaugugaccgguguaauaccacugacaacaacacccaccaaaucucauuuugcaaaucucaaaggaacagaaaccagggggaaacuaugcccaaaaugccuuaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaaaacagaaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaaugaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuauucaacugcugccuccaguuuggcuguaacacugaugauagcuaucuuuguuguuuauauggucuccagagacaauguuucuugcuccaucugucuauaa

SEQ ID NO: 58368 - RNA, 1758 nt, Artificial Sequence
  hemagglutinin__InfluenzaB__AHE38020
augaaggcaauaauuguacuacucaugguaguaacauccaaugcagaucgaaucugcacugggauaacaucgucaaacucaccacaugucgucaaaacugcuacucaaggggaggucaaugugaccgguguaauaccacugacaauaacacccaccaaaucucauuuugcaaaucucaaaggaacagaaaccagggggaaacuaugcccaaaaugccucaacugcacagaucuggacguagccuugggcagaccaaaaugcacagggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaagaugcaccaggaggacccuacaaaauuggaaccucagggucuugcccuaacguuaccaauggaaacggauucuucgcaacaauggcuugggccgucccaaaaaacgacaaaaacaaaacagcaacaaauccauuaacaauagaaguaccauacauuuguacagaaggagaagaccaaauuaccguuuggggguuccacucugacaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucuggaaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaagugaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaacggaugcuuugaaaccaaacauaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58369 - RNA, 1758 nt, Artificial Sequence
  hemagglutinin__InfluenzaB__AHE38021
augaaggcaauaauuguacuacucaugguaguaacauccaaugcagaucgaaucugcacugggauaacaucaucaaacucaccacaugucgucaaaacugcuacucaaggggaggucaaugugaccgguguaauaccacugacaacaacacccaccaaaucucauuuugcaaaucucaaagggacagaaaccagggggaaacucugcccaaaaugccucaacugcacagaucuggacguagccuugggcagaccaaaaugcacggggaaaauacccucggcaagaguuucaauacuccaugaagucagaccuguuacaucugggugcuuuccuauaaugcacgauagaacaaaaauuagacagcugccuaaccuucuccgaggauacgaacauaucagguuaucaacucacaacguuaucaaugcagaaaaugcaccaggaggacccuacaaaauuggaaccucagggucuugcccuaacguuaccaauggaaacggauucuucgcaacaauggcuugggccgucccaaaaaacgacaaaaacaagacagcaacaaauccauuaacaauagaaguaccauacauuuguacagaaggagaagaccaaauuaccguuuggggauuccacucugacaacgagacccaaauggcaaagcucuauggggacucaaauccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggguuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcugaccuuaagagcacucaagaggccauaaacaagauaacaaaaaaucucaacucuuugagugagcuggaaguaaagaaucuucaaagacuaagcggugccauggaugaacuccacaacgaaauacuagaacuagaugagaaaguggaugaucucagagcugauacaauaagcucacaaauagaacucgcaguccugcuuuccaaugaaggaauaauaaacagugaagaugaacaucucuuggcgcuugaaagaaagcugaagaaaaugcugggccccucugcuguagagauagggaauggaugcuuugaaaccaaacacaagugcaaucagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacacugaugauagcuaucuuuguuguuuauauggucuccagagacaauguuucuugcuccaucugucuauaa

SEQ ID NO: 58370 - RNA, 1758 nt, Artificial Sequence; identical to SEQ ID NO: 57391
  hemagglutinin__InfluenzaB__AHE38022

SEQ ID NO: 58371 - RNA, 1752 nt, Artificial Sequence
  hemagglutinin__InfluenzaB__AHL91189
augaaggcaauaauuguacuacucaugguagcaacauccaacgcagaucgaaucugcacugggauaacaucuucaaacucaccucauguggucaaaacagcuacucaaggggaagucaaugugacuggugugauaucacugacaacaacaccaacaaaaucucauuuugcaaaucucaaaggaacaaagaccagagggaaacuaugcccaaacugucucaacuguacagaucuggauguggccuugggcagaccaauauguauagggaccauaccuucggcaaaagcuucaauacuccacgaagucagaccuguuacauccgggugcuuuccuauaaugcacgacagaacaaaaaucagacaacuacccaaucuucucagaggauaugaacauaucagauugucaacccauaacguuaucaaugcagaaagggcaccgggaggacccuacagacuuggaaccucaggaucuugcccuaacguuaccaguagaagcggauucuucgcaacaauggcuugggcugucccaagggacaacaaaacagcaacgaacccacuaacaguagaaguaccauacauuuguacaaaaggagaagaccaaauuacuguuuggggguuccauucugauaacaaaacccaaaugaaaaaccucuauggagacucaaacccucaaaaguucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaaaguguggugugcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccucccgcaaaacuauuaaaggaaagggguuucuucggagcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuuaagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaaugaaggaauaauaaacagugaagaugagcaucuauuggcacuugaaagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuugcuccaucugucuauag

SEQ ID NO: 58372 - RNA, 1752 nt, Artificial Sequence
  hemagglutinin__InfluenzaB__AHL91200
augaaggcaauaauuguacuacucaugguaguaacauccaacgcagaucgaaucugcacugggauaacaucuucaaacucaccucauguggucaaaacagccacucaaggggaagucaaugugacuggugugauaccacugacaacaacaccaacaaaaucucauuuugcaaaucucaaaggaacaaagaccagagggaaacuaugcccaaacugucucaacuguacagaucuggauguggccuugggcagaccaauguguauagggaccauaccuucagcaaaagcuucaauacuccacgaagucagaccuguuacauccgggugcuuuccuauaaugcacgacagaacaaaaaucagacagcuacccaaucuucucagaggauaugaacauaucagauuaucaacccauaacguuaucaacgcagaaagggcaccaggaggacccuacagacuuggaaccucagggucuugcccuaauguuaccaguagaagcggauucuucgcaacaauggcuugggcugucccaagggacaacaaaacagcaacgaacccacuaacaguagaaguaccauacauuuguacaaaaggagaagaccaaauuacuguuuggggguuccauucugauaacaaaacccaaaugaaaaaccucuauggagacucaaauccucaaaaguucaccucaucugccaauggaguaaccacacauuauguuucucagauuggugacuucccaaaucaaacagaagacggagggcuaccacaaagcggcagaauuguuguugauuacauggugcaaaaaccugggaaaacaggaacaauugucuaucaaagagguguuuuguugccucaaaagguguggugugcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccucccgcaaaacuauuaaaggaaagggguuucuucggagcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaaugaaggaauaauaaacagugaagaugagcaucuauuagcacuugaaagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacuaaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucuuguuccaucugucuauag

SEQ ID NO: 58373 - RNA, 1752 nt, Artificial Sequence
  hemagglutinin__InfluenzaB__AHL91211
augaaggcaauaauuguacuacucaugguagcaacauccaacgcagaucgaaucugcacugggauaacaucuucaaacucaccucauguggucaaaacagcuacucaaggggaagucaaugugacuggugugauaucacugacaacaacaccaacaaaaucucauuuugcaaaucucaaaggaacaaagaccagagggaaacuaugcccaaacugucucaacuguacagaucuggauguggccuugggcagaccaauguguauagggaccauaccuucggcaaaagcuucaauacuccacgaagucagaccuguuacauccgggugcuuuccuauaaugcacgacagaacaaaaaucagacaacuacccaaucuucucaggggauaugaacauaucagauuaucaacccauaacguuaucaaugcagaaagggcaccgggaggacccuacagacuuggaaccucaggaucuugcccuaauguuaccaguagaagcggauucuucgcaacaauggcuugggcugucccaagggacaacaaaacagcaacgaacccacuaacaguagaaguaccauacauuuguacaaaaggagaagaccaaauuacuguuuggggguuccauucugauaacaaaacccaaaugaaaaaccucuauggagacucaaacccucaaaaguucaccucaucugccaauggaguaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugugcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccagcaaaacuauuaaaggaaagggguuucuucggugcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucgcaaauagagcuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaucauacuauacugcucuacuacucaacugcugcuucuaguuuggcuguaacauugaugauagcuauuuuuauuguuuauauggucuccagagacaauguuucgugcuccaucugucuauag

SEQ ID NO: 58374 - RNA, 1755 nt, Artificial Sequence
  hemagglutinin__InfluenzaB__AHL91222
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaaugcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaagugccauacguuuguacagaaggagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccagaucaaacagaagacggagggcuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuccccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauauggucuccagagacaauauuucaugcuccaucugucuauaa

SEQ ID NO: 58375 - RNA, 1755 nt, Artificial Sequence
  hemagglutinin__InfluenzaB__AHL91244
augaaggcaauaauuguacuacucaugguaguaacaucuaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuugggcagaccaauguguguggggaccacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccauacauuuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccagaucaaacagaagacggagggcuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggguacacaucucacggagcacauggaguggcaguggcagcagaccuuaagaguacgcaagaagccauaaacaagauaacaaaaaaucucaauucuuugagugaacuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcacuuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauauggucuccagagacaauguuucuugcuccaucugucuauaa

SEQ ID NO: 58376 - RNA, 1755 nt, Artificial Sequence
  hemagglutinin__InfluenzaB__AHL91255
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguguggggaccacaccuucggcaaaagcuucaauacuccacgaagucagaccuguuacauccgggugcuuuccuauaaugcacgacagaacaaaaaucagacagcuacccaaucuucucagaggauaugaaaauaucagauuaucaacccaaaacguuaucaaugcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccauacguuuguacagaaggagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccagaucaaacagaagacggagggcuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccauuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaagaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuggacaggauagcugcuggcaccuuuaaugcaggagaauuuucucuccccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauauggucuccagagacaauguuucaugcuccaucugucuauaa

SEQ ID NO: 58377 - RNA, 1755 nt, Artificial Sequence; identical to SEQ ID NO: 58376
  hemagglutinin__InfluenzaB__AHL91266

SEQ ID NO: 58378 - RNA, 1752 nt, Artificial Sequence
  hemagglutinin__InfluenzaB__AHL91277
augaaggcaauaauuguacuacucaugguaguaacauccaacgcagaucgaaucugcacugggauaacaucuucaaacucaccucauguggucaaaacagcuacucaaggggaagucaaugugacuggugugauaccacugacaacaacaccaacaaaaucucauuuugcaaaucucaaaggaacaaagaccagagggaaacuaugcccaaacugucucaacugcacagaucuggauguggccuugggcagaccaauguguauagggaucacaccuucggcaaaagcuucaauacuccacgaagucagaccuguuacauccgggugcuuuccuauaaugcacgacagaacaaaaaucagacagcuacccaaucuucucagaggauaugaacauaucagauuaucaacccauaacguuaucaacgcagaaagggcaccaggaggacccuacagacuuggaaccucaggaucuugcccuaacguuaccaguagaagcggauucuucgcaacaauggcuugggcugucccaagggacaacaaaacagcaacgaacccacuaacaguagaaguaccauacauuuguacaaaaggagaagaccaaauuacuguuuggggguuccauucugauaacaaaacccaaaugaaaaaccucuauggagacucaaauccucaaaaguucaccucaucugccaauggaauaaccacacauuauguuucucagauugguggcuucccaaaucaaacagaagacggagggcuaccacaaagcggcagaauuguuguugauuacauggugcaaaaaccugggaaaacaggaacaauugucuaucaaagagguguuuuguugccucaaaagguguggugugcaaguggcaggagcaagguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuuaaagcuugccaauggaaccaaauauagaccucccgcaaaacuauuaaaggaaagggguuucuucggagcuauugcugguuucuuagaaggaggaugggaaggaaugauugcagguuggcacggauacacaucucauggagcacaugggguggcaguggcagcagaccuuaagaguacgcaagaagccauaaacaagauaacaaaaaaucucaauucuuugagugagcuagaagugaagaaucuucaaagacuaaguggugccauggaugaacuccacaacgaaauacucgagcuggaugagaaaguggaugaucucagagcugacacaauaagcucgcaaauagagcuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuggacaggauagcugcuggcaccuuuaaugcaggagaauuuucucuucccacuuuugauucacugaauauuacugcugcaucuuuaaaugaugauggauuggauaaucauacuauacugcucuacuacucaacugcggcuucuaguuuggcuguaacauugaugauagcuauuuuuauuguuuauauggucuccagagacaauguuucuugcuccaucugucuauag

SEQ ID NO: 58379 - RNA, 1755 nt, Artificial Sequence
  hemagglutinin__InfluenzaB__AHL91299
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaagaucucauuuugcaaaucucaaaggaacaaagaccagagggaaacuaugcccaaccugucucaacugcacagaucuggauguggccuugggcagaccaauguguguggggaccacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccauacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58380 - RNA, 1755 nt, Artificial Sequence
  hemagglutinin__InfluenzaB__AHL91310
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuugggcagaccaauguguguggggaccacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccauacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaucuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58381 - RNA, 1755 nt, Artificial Sequence
  hemagglutinin__InfluenzaB__AHL91321
augaaggcaauaauuguacuacucaugguaguaacauccaaugcagaucgaaucugcacugggauaacaucgucaaacucaccucauguggucaaaacagcuacucaaggggaggucaaugugacugguguuauaccacugacaacaacaccaacaaaaucucauuuugcaaaucucaaaggaacaaagaccagagggaaacuaugcccaaccugucucaacugcacagaucuggauguggccuugggcagaccaauguguguggggaccacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacaggcuuggaaccucaggaucuugcccuaacgcuaccaguagaagcggauuuuucgcaacaauggcuugggcugucccaagggacaacaacaaaacagcaacgaauccacuaacaguagaaguaccauacauuuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaaaggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauauggucuccagagacaauguuucuugcuccaucugucuauaa

SEQ ID NO: 58382 - RNA, 1755 nt, Artificial Sequence
  hemagglutinin__InfluenzaB__AHL91332
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccaacaaaaucucauuuugcaaaucucaaaggaacaaagaccagagggaaacuaugcccaaccugucucaacugcacagaucuggauguggccuugggcagaccaauguguguggggaccacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccauacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuauugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccacacuauacugcuuuacuacucaacugcugcuucuaguuuggcuguaacauugaugauagcuauuuuuauuguuuauaugaucuccagagacaauguuucuugcuccaucugucuauaa

SEQ ID NO: 58383 - RNA, 1755 nt, Artificial Sequence; identical to SEQ ID NO: 58382
  hemagglutinin__InfluenzaB__AHL91343

SEQ ID NO: 58384 - RNA, 1755 nt, Artificial Sequence; identical to SEQ ID NO: 58382
  hemagglutinin__InfluenzaB__AHL91354

SEQ ID NO: 58385 - RNA, 1755 nt, Artificial Sequence; identical to SEQ ID NO: 56983
  hemagglutinin__InfluenzaB__AHL91365

SEQ ID NO: 58386 - RNA, 1755 nt, Artificial Sequence
  hemagglutinin__InfluenzaB__AHL91376
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacagcaacaccaacaaaaucucauuuugcaaaucucaaaggaacaaagaccagagggaaacuaugcccaaccugucucaacugcacagaucuggauguggccuuaggcagaccaaugugugugggggucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacucaaaacguuaucaacgcagaaaaggcaccaggaggacccuacagacuuggaaccucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauuggcggcuucccggaucaaacagaagacggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuccacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58387 - RNA, 1755 nt, Artificial Sequence
  hemagglutinin__InfluenzaB__AHL91387
augaaggcaauaauuguacuacucaugguaguaacauccaaugcagaucgaaucugcacugggauaacaucgucaaacucaccucauguggucaaaacagcuacucaaggggaggucaaugugacuggugugauaccacugacaacaacaccagcaaaaucucauuuugcaaaucucaaaggaacaaagaccagagggaaacuaugcccaacuugucucaacugcacagaucuggauguggccuuaggcagaccaaugugugugggggucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaaccucaggaucuugcccuaacgcuaccaguagaagcggauuuuucgcaacaauggcuugggcuguuccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaguaaccacacauuauguuucucagauugguggcuucccggaucaaacagaagauggagggcuaccacaaagcggcagaauuguuguugauuacauggugcaaaaaccugggaaaacaggaacaauugucuaucaaagagguauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccaccugcaaaacuauuaaaggaaagggguuucuucggagcuauugcugguuucuuagaagggggaugggaaggaaugauugcagguuggcacggauacacaucucacggagcacauggaguggcaguggcagcagaccuuaagaguacgcaagaagccauaaacaagauaacaaaaaaucucaauucuuugagcgagcuagaaguaaagaaucuucaaagacuaaguggugccauggaugaacuccacaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaauauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58388 - RNA, 1755 nt, Artificial Sequence
  hemagglutinin__InfluenzaB__AHL91409
augaaggcaauaauuguacuacucaugguaguaacauccaaugcagaucgaaucugcacugggauaacaucgucagacucaccucauguggucaaaacagcuacucaaggggaggucaaugugacuggugcgauaccacugacaacaacaccaacaaaaucuuauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguagaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauuggcggcuucccggaucaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugguugcagguuggcacggauacacaucucacggagcacauggaguggcaguggcagcagaccuuaagaguacgcaagaagccauaaacaagauaacaaaaaaucucaauucuuugagugagcuagaaguaaagaaucuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguggacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58389 - RNA, 1755 nt, Artificial Sequence
  hemagglutinin__InfluenzaB__AHL91431
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauuuuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58390 - RNA, 1755 nt, Artificial Sequence
  hemagglutinin__InfluenzaB__AHL91442
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagaggaaagcuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaacggcaccaggaggacccuacagacuuggaacuucaggaucuugcccuaacgcuaccaguaaaagcggauuuuucgcaacaauggcuugggcugucccaagggacaacaacaaaacagcaacgaauccacuaacgguagaaguaccacacaucuguacaaaagaagaagaccaaauuacuguuuggggguuccauucugauaacaaaacccaaaugaaaaaccucuauggagacucaaauccucaaaaguucaccucaucagcuaaugggauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauugaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaaaauaacaaaaaaucucaauucuuugagugagcuagaaguaaagaaccuucaaagacuaaguggugccauggaugaacuccauaacgaaauacucgagcuggaugagaaaguggaugaucucagggcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58391 - RNA, 1755 nt, Artificial Sequence
  hemagglutinin__InfluenzaB__AHL91453
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacaguuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaauagaaguaccacacgucuguacaaaagaagaagaccaaauuacuguuuggggguuccauucugauaacaaaacccaaaugaaaaaccucuauggagacucaaauccucaaaaguucaccucgucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccggcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58392 - RNA, 1755 nt, Artificial Sequence
  hemagglutinin__InfluenzaB__AHL91464
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagauuuggauguggccuugggcagaccaauguguguggggaucacaccuucggcaaaagcuucaauacuccaugaagucagaccuguuacauccggaugcuuuccuauaaugcacgacagaacaaaaaucagacagcuacccaaucuucucagaggauaugaaaaaaucagauuaucaacacaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccccaaaaguucaccucaucugcuaauggaauaaccacacauuauguuucucagaucggcggcuucccggaccaaacagaagacggaggccuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggguacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58393 - RNA, 1755 nt, Artificial Sequence
  hemagglutinin__InfluenzaB__AHL91475
augaaggcaauaauuguacuacucaugguaguaacauccaaugcagaucgaaucugcacugggauaacaucgucaaacucaccucauguggucaaaacagcuacucaaggggaggucaaugugacuggugcgaucccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaagugccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaauuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58394 - RNA, 1755 nt, Artificial Sequence; identical to SEQ ID NO: 58390
  hemagglutinin__InfluenzaB__AHL91486

SEQ ID NO: 58395 - RNA, 1755 nt, Artificial Sequence; identical to SEQ ID NO: 58390
  hemagglutinin__InfluenzaB__AHL91497

SEQ ID NO: 58396 - RNA, 1755 nt, Artificial Sequence; identical to SEQ ID NO: 58390
  hemagglutinin__InfluenzaB__AHL91530

SEQ ID NO: 58397 - RNA, 1755 nt, Artificial Sequence
  hemagglutinin__InfluenzaB__AHL91541
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58398 - RNA, 1755 nt, Artificial Sequence; identical to SEQ ID NO: 58390
  hemagglutinin__InfluenzaB__AHL91552

SEQ ID NO: 58399 - RNA, 1755 nt, Artificial Sequence
  hemagglutinin__InfluenzaB__AHL91574
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagaggaaagcuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaacggcaccaggaggacccuacagacuuggaacuucaggaucuugcccuaacgcuaccaguaaaagcggauuuuucgcaacaauggcuugggcugucccaagggacaacaacaaaacagcaacgaauccacuaacgguagaaguaccacacaucuguacaaaagaagaagaccaaauuacuguuuggggguuccauucugauaacaaaacccaaaugaaaaaccucuauggagacucaaauccucaaaaguucaccucaucagcuaaugggauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauugaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaaaauaacaaaaaaucucaauucuuugagugagcuagaaguaaagaaccuucaaagacuaaguggugccauggaugaacuccauaacgaaauacucgagcuggaugagaaaguggaugaucucagggcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggggaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58400 - RNA, 1755 nt, Artificial Sequence
  hemagglutinin__InfluenzaB__AHL91585
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcuguuccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaaugaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaacgaaggaauaauaaacagugaagaugagcaucuguuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58401 - RNA, 1755 nt, Artificial Sequence
  hemagglutinin__InfluenzaB__AHL91596
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuuguccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuauugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaaauauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58402 - RNA, 1755 nt, Artificial Sequence
  hemagglutinin__InfluenzaB__AHL91607
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuuguccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaaauauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58403 - RNA, 1755 nt, Artificial Sequence
  hemagglutinin__InfluenzaB__AHL91618
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucuuaaaggaacaaagaccagaggaaagcuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaacggcaccaggaggacccuacagacuuggaacuucaggaucuugcccuaacgcuaccaguaaaagcggauuuuucgcaacaauggcuugggcugucccaagggacaacaacaaaacagcaacgaauccacuaacgguagaaguaccacacaucuguacaaaagaagaagaccaaauuacuguuuggggguuccauucugauaacaaaacccaaaugaaaaaccucuauggagacucaaauccucaaaaguucaccucaucagcuaaugggauaaccacacauuauguuucucagauuggcggcuucccggaccaaacagaagacggagggcuaccacaaagcggcagaauuguuguugauuacauggugcaaaaaccugggaaaacaggaacaauugucuaccaaagagggauuuuguugccucaaaagguguggugcgcgaguggcaggagcaaaguaauaaaaggguccuugccuuuaauuggugaagcagauugccuucacgaaaaauacgguggauugaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcgcauggaguggcaguggcagcagaccuuaagaguacgcaagaagccauaaacaaaauaacaaaaaaucucaauucuuugagugagcuagaaguaaagaaccuucaaagacuaaguggugccauggaugaacuccauaacgaaauacucgagcuggaugagaaaguggaugaucucagggcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaauguaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58404 - RNA, 1755 nt, Artificial Sequence
  hemagglutinin__InfluenzaB__AHL91629
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacaaacuuggaacuucaggaucuugcccuaacgcuaccaguaaaagcggauuuuucgcaacaauggcuugggcugucccgagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagagcacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58405 - RNA, 1755 nt, Artificial Sequence; identical to SEQ ID NO: 58404
  hemagglutinin__InfluenzaB__AHL91640

SEQ ID NO: 58406 - RNA, 1755 nt, Artificial Sequence
  hemagglutinin__InfluenzaB__AHL91651
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccaaggggcaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaaaccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58407 - RNA, 1752 nt, Artificial Sequence
  hemagglutinin__InfluenzaB__AHL91662
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagaggaaagcuaugcccaaccugucucaacugcacagaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucaacgcagaaacggcaccaggaggacccuacagacuuggaacuucaggaucuugcccuaacgcuaccaguaaaagcggauuuuucgcaacaauggcuugggcugucccaagggacaacaacaaaacagcaacgaauccacuaacgguagaaguaccacacaucuguacaaaagaagaagaccaaauuacuguuuggggguuccauucugauaacaaaacccaaaugaaaaaccucuauggagacucaaauccucaaaaguucaccucaucagcuaaugggauaaccacacauuauguuucucagauuggcggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcagauugccuucacgaaaaauacgguggauugaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuucuuagaaggaggaugggaaggaaugauugcagguuggcacggauacacaucucacggagcacauggaguggcaguggcagcagaccuuaagaguacgcaagaagccauaaacaaaauaacaaaaaaucucaauucuuugagugagcuagaaguaaagaaccuucaaagacuaaguggugccauggaugaacuccauaacgaaauacucgagcuggaugagaaaguggaugaucucagggcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugauggauuggauaaccauacuauacugcucuacuacucaacugcugcuucuaguuuggcugugacauugaugauagcuauuuuuauuguuuauaugaucuccagagacaauguuucuugcuccaucugucuauaa

SEQ ID NO: 58408 - RNA, 1755 nt, Artificial Sequence
  hemagglutinin__InfluenzaB__AHL91673
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccgagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagagcacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58409 - RNA, 1755 nt, Artificial Sequence
  hemagglutinin__InfluenzaB__AHL91684
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccugucucaacugcacagaucuggauguggccuugggcagaccaauguguguggggaucacaccuucggcaaaagcuucaauacuccacgaagucagaccuguuacauccggaugcuuuccuauuaugcacgacagaacaaaaaucagacagcuacccaaucuucucagaggauaugaaaaaaucagauuaucaacccaaaacguuaucaacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaauagaaguaccacacaucuguacaaaagaagaagaccaaauuacuguuuggggguuccauucugauaacaaaacccaaaugaaaaaccucuauggagacucaaauccucaaaaguucaccucgucugcuaauggaauaaccacacauuauguuucucagauugggggcuucccggaccaaacggaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguucuugccuuuaauuggugaagcagauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccggcaaaacuauuaaaggaaagggguuucuucggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaagcucacaaauagaacuugcagucuugcuuuccaacgaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58410 - RNA, 1755 nt, Artificial Sequence
  hemagglutinin__InfluenzaB__AHL91695
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccaaggggcaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58411 - RNA, 1755 nt, Artificial Sequence
  hemagglutinin__InfluenzaB__AHL91706
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaagaccagagggaaacuaugcccaaccuguuucaacugcaccgaucuggauguggccuugggcagaccaauguguguggggaucacaccuucggcaaaagcuucaauacuccacgaagucagaccuguuacauccggaugcuuuccuauaaugcacgacagaacaaaaaucagacagcuacccaaucuucucagaggauaugaaaaaaucagauuaucaacccaaaacguuaucgacgcagaaaaggcaccaggaggacccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucaaauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggguccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauacagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagacuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucucuagagacaauguuucuugcuccaucugucuauaa

SEQ ID NO: 58412 - RNA, 1758 nt, Artificial Sequence
  hemagglutinin__InfluenzaB__AHL91717
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaucuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaagagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagaguacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcagucuugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58413 - RNA, 1758 nt, Artificial Sequence
  hemagglutinin__InfluenzaB__AHL91728
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaagcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58414 - RNA, 1758 nt, Artificial Sequence; identical to SEQ ID NO: 57563
  hemagglutinin__InfluenzaB__AHL91739

SEQ ID NO: 58415 - RNA, 1755 nt, Artificial Sequence
  hemagglutinin__InfluenzaB__AHL91750
augaaggcaauaauuguacuacucaugguaguaacauccaaugcagaucgaaucugcacugggauaacaucgucaaacucaccucauguggucaaaacagcuacucaaggggaggucaaugugacuggugcgauaccacugacaacaacaccaacaaaaucucauuuugcaaaucucaaaggaacaaaaaccagagggaaacuaugcccaaccuguuucaacugcaccgaucuggauguggccuuaggcagaccaauguguguggggaucacaccuucggcaaaagcuucaauacuccacgaagucagaccuguuacauccggaugcuuuccuauaaugcacgacagaacaaaaaucagacagcuacccaaucuccucagaggauaugaaaaaaucagauuaucaacccaaaacguuaucgacgcagaaaaggcaccaggagggcccuacagacuuggaacuucaggaucuugcccuaacgcuaccaguaaaagcggauuuuucgcaacaauggcuugggcugucccaagggacaacaacaaaacagcaacgaauccacuaacaguagaaguaccacacaucuguacaaaagaagaagaccaaauuacuguuuggggguuccauucugauaacaaaacccaaaugaaaaaccucuauggagacucaaauccucaaaaguucaccucaucugcuaauggaauaaccacacauuauguuucucagauugggggcuucccggaccaaacagaagacggagggcuaccacaaagcggcagaauuguuguugauuacauggugcaaaaaccugggaaaacaggaacaauugucuaucaaagagggauuuuguugccucaaaagguguggugcgcgaguggcaggagcaaaguaauaaaaggauccuugccuuuaauuggugaagcugauugccuucacgaaaaauacgguggauuaaacaaaagcaagccuuacuacacaggagaacaugcaaaagccauagggaauugcccaauaugggugaaaacaccuuugaagcuugccaauggaaccaaauauagaccuccugcaaaacuauuaaaggaaagggguuucuuuggagcuauugcugguuucuuagaaggaggaugggaaggaaugauugcagguuggcacggauacacaucucacggagcacacggaguggcaguggcagcagaccuuaagaguacgcaagaagccauaaacaagauaacaaaaaaucucaauucuuugagugagcuagaaguaaagaaccuucaaagauuaaguggugccauggaugaacuccauaacgaaauacucgagcuggaugagaaaguggaugaucucagagcugacacaauaaguucacaaauagaacuugcagucuugcuuuccaaugaaggaauaauaaacagugaagaugagcaucuauuggcacuugagagaaaacuaaagaaaaugcugggucccucugcuguagacauagggaauggaugcuucgaaaccaaacacaagugcaaccagaccugcuuagacaggauagcugcuggcaccuuuaaugcaggagaauuuucucuucccacuuuugauucacugaacauuacugcugcaucuuuaaaugaugauggauuggauaaccauacuauacugcucuacuacucaacugcugcuucuaguuuggcuguaacauugaugauagcuauuuuuauuguuuauaugaucuccagagacaauguuucuugcuccaucugucuauaa

SEQ ID NO: 58416 - RNA, 1758 nt, Artificial Sequence; identical to SEQ ID NO: 57576
  hemagglutinin__InfluenzaB__AHL91761

SEQ ID NO: 58417 - RNA, 1758 nt, Artificial Sequence
  hemagglutinin__InfluenzaB__AHL91772
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcaaaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacauuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuuaccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58418 - RNA, 1758 nt, Artificial Sequence; identical to SEQ ID NO: 58417
  hemagglutinin__InfluenzaB__AHL91783

SEQ ID NO: 58419 - RNA, 1758 nt, Artificial Sequence; identical to SEQ ID NO: 58417
  hemagglutinin__InfluenzaB__AHL91794

SEQ ID NO: 58420 - RNA, 1758 nt, Artificial Sequence
  hemagglutinin__InfluenzaB__AHL91805
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugcuucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58421 - RNA, 1758 nt, Artificial Sequence; identical to SEQ ID NO: 56923
  hemagglutinin__InfluenzaB__AHL91816

SEQ ID NO: 58422 - RNA, 1758 nt, Artificial Sequence
  hemagglutinin__InfluenzaB__AHL91827
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuacaucugggugcuuuccuauaaugcacgacagaacaaaaauuagacagcugcccaaccuucucagaggauacgaacauaucagguuaucaacucauaacguuaucaaugcagaaaaggcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugaucgcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuagcgcuugaaagaaagcugaagaaaaugcugggccccucugcuguagagauagggaauggaugcuucgaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58423 - RNA, 1755 nt, Artificial Sequence; identical to SEQ ID NO: 58034
  hemagglutinin__InfluenzaB__AHL91838

SEQ ID NO: 58424 - RNA, 1755 nt, Artificial Sequence
  hemagglutinin__InfluenzaB__AHL91849
augaaggcaauaauuguacuacucaugguaguaacauccaaugcagaucgaaucugcacugggauaacaucuucaaacucaccucauguagucaaaacagcuacucaaggggaggucaaugugacugguguaauaccacugacaacaacaccaacaaaaucuuauuuugcaaaucucaaaggaacaagaaccagagggaaacuauguccagacugucucaacuguacagaucuggauguggccuugggcagaccaaugugugugggaaccacaccuucggcaaaagcuucaauacuccacgaagccagaccuguuacauccgggugcuuuccuauaaugcacgacagaacaaaaaucagacaacuacccaaucuucucagaggauaugaaaauaucagauuaucaacucaaaacguuaucgaugcagaaaaugcaccaggaggacccuacagacuuggaaccucaggaucuugcccuaacgcuaccaguaaaaguggauuuuucgcaacaauggcuugggcugucccaaaggacaacaacaaaaaugcaacgaacccacuaacaguagaaguaccauacauuuguaaagaaggggaagaccaaauuacuguuugggguuuccauucagauaacaaaacccaaaugaagaaccucuauggagacucaaauccucaaaaguucaccucaucugcuaauggaguaaccacacauuauguuucucagauuagcggcuucccagcucaaacagaagacggaggacuaccacaaagcggcagaauuguuguugauuacauggugcaaaaaccuaggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaagacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaaugaaggaauaauaaacagugaagaugagcaucuauuggcacuugagagaaaacuaaagaaaaugcugggucccucugcuguagacauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58425 - RNA, 1755 nt, Artificial Sequence
  hemagglutinin__InfluenzaB__AHL91860
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacgucaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagagauaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcggcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccaugcuauacugcucuauuacucaacugcugcuucuaguuuggcuguaacauugaugcuagcuauuuuuauuguuuauauggucuccagagacaacguuucaugcuccaucugucuauaa

SEQ ID NO: 58426 - RNA, 1755 nt, Artificial Sequence
  hemagglutinin__InfluenzaB__AHL91871
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacgucaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagagauaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcggcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58427 - RNA, 1755 nt, Artificial Sequence; identical to SEQ ID NO: 57159
  hemagglutinin__InfluenzaB__AHL91882

SEQ ID NO: 58428 - RNA, 1755 nt, Artificial Sequence
  hemagglutinin__InfluenzaB__AHL91904
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacucaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaacaugggaaaacaggaacaauugucuaucaaagagguguuuuguugccucaaaagguguggugcgcgagugguaggagcaaaguaauaaaaggguccuugccuuuaauuggugaagcagacugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58429 - RNA, 1755 nt, Artificial Sequence
  hemagglutinin__InfluenzaB__AHL91915
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaagaaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58430 - RNA, 1755 nt, Artificial Sequence; identical to SEQ ID NO: 57528
  hemagglutinin__InfluenzaB__AHL91926

SEQ ID NO: 58431 - RNA, 1755 nt, Artificial Sequence
  hemagglutinin__InfluenzaB__AHL91937
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucccacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacagcgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58432 - RNA, 1755 nt, Artificial Sequence
  hemagglutinin__InfluenzaB__AHL91948
augaaggcaauaauuguacuacucaugguaguaacauccaaugcagaucggaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaucuggauguggccuugggcaggccaauguguguggggaccacaccuucugcgaaagcuucaauacuccacgaagucagaccuguuacauccgggugcuuuccuauaaugcacgacagaacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcauuuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58433 - RNA, 1758 nt, Artificial Sequence
  hemagglutinin__InfluenzaB__AHL91959
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacguuaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagauggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuuaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58434 - RNA, 1758 nt, Artificial Sequence
  hemagglutinin__InfluenzaB__AHL91970
augaaggcaauaauuguacuacucaugguaguaacauccaaugcagaucgaaucugcacugggauaacaucgucaaacucaccccauguggucaaaacugcuacucaaggggaggucaaugugacuggugugauaccacugacaacaacacccaccaaaucucauuuugcaaaucucaaaggaacaaaaaccagagggaaacuaugcccaaaaugccucaacugcacagaucuggacguggccuugggcagaccaaaaugcacggggaacauacccucggcagaaguuucaauacuccaugaagucagaccuguuaccucugggugcuuuccuauaaugcacgacagaacaaaaauuagacagcugcccaaccuucucagaggauacgaacauaucagauuaucaacucauaacgucaucaaugcagaaaaggcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccauuuggggguuccacucugauaacgaaacccaaauggcaaaacucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugcccuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcaguggcagcagaccuuaagagcacucaagaagccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuucgaaaccaaacacaagugcaaccagaccugucuugacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuguag

SEQ ID NO: 58435 - RNA, 1755 nt, Artificial Sequence
  hemagglutinin__InfluenzaB__AHL91991
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccagacugucucaacuguacagaccuggauguggccuugggcaggccaauguguguggggaccacaccuucugcgaaagcuucaauacuccacgaagucagaccuguuacauccgggugcuuuccuauaaugcacgacagaacaaaaaucagacaacuagccaaucuucucagaggauaugaaaauaucagguuaucaacccaaaacguuaucgaugcagaaaaggcaccaggaggacccuacagacuuggaaccucaggaucuugcccuaacgcuaccaauaaaagcggauuuuucgcaacaauggcuugggcugucccuaaggacaacaacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauaugguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguagcaguggcggcagaccuuaagaguacacaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58436 - RNA, 1758 nt, Artificial Sequence
  hemagglutinin__InfluenzaB__AHL92002
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacuucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58437 - RNA, 1758 nt, Artificial Sequence; identical to SEQ ID NO: 58436
  hemagglutinin__InfluenzaB__AHL92013

SEQ ID NO: 58438 - RNA, 1758 nt, Artificial Sequence
  hemagglutinin__InfluenzaB__AHL92024
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaauggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaagggggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58439 - RNA, 1758 nt, Artificial Sequence
  hemagglutinin__InfluenzaB__AHL92035
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58440 - RNA, 1758 nt, Artificial Sequence
  hemagglutinin__InfluenzaB__AHL92046
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacugccacaaagugguagaauuguuguugauuacauggugcaaaaaucugggaaaacaggaacaauuaccuaucaaagagguauuuuauugccucaaaagguguggugcgcaaguggcagaagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58441 - RNA, 1758 nt, Artificial Sequence; identical to SEQ ID NO: 57737
  hemagglutinin__InfluenzaB__AHL92057

SEQ ID NO: 58442 - RNA, 1758 nt, Artificial Sequence
  hemagglutinin__InfluenzaB__AHL92068
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagguugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguugcgguggcagcagaccuuaagagcacucaagaggccauaaacaagauaacaaaaaaucucaacucuuugagugagcuggaaguaaagaaucuucaaagacugagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58443 - RNA, 1758 nt, Artificial Sequence
  hemagglutinin__InfluenzaB__AHL92079
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguugcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagagcuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccacuuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58444 - RNA, 1758 nt, Artificial Sequence
  hemagglutinin__InfluenzaB__AHL92090
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguugcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagagcuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58445 - RNA, 1758 nt, Artificial Sequence
  hemagglutinin__InfluenzaB__AHL92101
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacgacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgauaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacuggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacuaaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58446 - RNA, 1755 nt, Artificial Sequence
  hemagglutinin__InfluenzaB__AHL92112
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58447 - RNA, 1758 nt, Artificial Sequence
  hemagglutinin__InfluenzaB__AHL92123
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuauguccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuuguccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58448 - RNA, 1758 nt, Artificial Sequence
  hemagglutinin__InfluenzaB__AHL92134
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguugcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58449 - RNA, 1758 nt, Artificial Sequence; identical to SEQ ID NO: 58448
  hemagglutinin__InfluenzaB__AHL92145

SEQ ID NO: 58450 - RNA, 1758 nt, Artificial Sequence; identical to SEQ ID NO: 58439
  hemagglutinin__InfluenzaB__AHL92156

SEQ ID NO: 58451 - RNA, 1758 nt, Artificial Sequence; identical to SEQ ID NO: 58444
  hemagglutinin__InfluenzaB__AHL92167

SEQ ID NO: 58452 - RNA, 1758 nt, Artificial Sequence; identical to SEQ ID NO: 58439
  hemagglutinin__InfluenzaB__AHL92178

SEQ ID NO: 58453 - RNA, 1758 nt, Artificial Sequence
  hemagglutinin__InfluenzaB__AHL92189
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuagauguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58454 - RNA, 1755 nt, Artificial Sequence; identical to SEQ ID NO: 58446
  hemagglutinin__InfluenzaB__AHL92200

SEQ ID NO: 58455 - RNA, 1758 nt, Artificial Sequence
  hemagglutinin__InfluenzaB__AHL92211
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuauguccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuuguccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuauucaacugcugccuccaguuuggcuguaacauugaugauagcuaucuuuguuguuuauauggucuccagagacaauguuucuugcuccaucugucuauaa

SEQ ID NO: 58456 - RNA, 1758 nt, Artificial Sequence
  hemagglutinin__InfluenzaB__AHL92222
augaaggcaauaauuguacuacucaugguaguaacaucuaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggaucccugccuuuaauuggagaagcagauugccuccacgaaaaauacgguggauuaaacaaaagcaagccuuauuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuauuacucaacugcugccuccaguuuggcuguaacauugaugauagcuaucuuuguuguuuauauggucuccagagacaauguuucuugcuccaucugucuauaa

SEQ ID NO: 58457 - RNA, 1755 nt, Artificial Sequence
  hemagglutinin__InfluenzaB__AHL92233
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuauuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaacaagauaacaaaaaaucucaauucuuugagugagcuagaaguaaagaaucuucaaagacuaaguggugccauggaugaacuccacaacgaaauacucgagcuggaugaaaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58458 - RNA, 1758 nt, Artificial Sequence
  hemagglutinin__InfluenzaB__AHL92244
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacauuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58459 - RNA, 1758 nt, Artificial Sequence
  hemagglutinin__InfluenzaB__AHL92255
augaaggcaauaauuguacuacucaugguaguaacauccaaugcagauagaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagagguaccauacauuuguacagaaggagaagaccaaauuaccguuuggggguuccacucugauaacgagacccaaauggcaaagcucuauggggacucaaagccccagaaguucaccucaucugccaacggagugacaacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuauacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58460 - RNA, 1758 nt, Artificial Sequence
  hemagglutinin__InfluenzaB__AHL92266
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuauguccaaaaugccucaacugcacagaucuggacguggccuugggcagaccaaaauguacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuuguccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaauggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58461 - RNA, 1758 nt, Artificial Sequence
  hemagglutinin__InfluenzaB__AHL92277
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaaugcagaaaaugcaccaggaggacccuacaaaauuggaaccucagggucuugcccuaacguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgagacccaaauggcaaagcucuauggggacucaaagccccagaaguucaccucaucugccaacggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaagguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaagagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcuacugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58462 - RNA, 1758 nt, Artificial Sequence
  hemagglutinin__InfluenzaB__AHL92288
augaaggcaauaauuguacuacucaugguaguaacauccaaugcagaucgaaucugcacugggauaacaucgucaaacucaccacauguugucaaaacugcuacucaaggggaggucaaugugacugguguaauaccacugacaacaacacccaccaaaucucauuuugcaaaucucaaaggaacagaaaccagagggaaacuaugcccaaaaugccucaacugcacagaucuggacguggccuugggcagaccaaaaugcacggggaacauacccucggcaagaguuucaauacuccaugaagucagaccuguuacaucugggugcuuuccuauaaugcacgacagaacaaaaauuagacagcugccuaaccuucucagaggauacgaacauaucagguuaucaacucauaacguuaucaacgcagaaaaugcaccaggaggacccuacaaaauuggaaccucagggucuugcccuaauguuaccaauggaaacggauuuuucgcaacaauggcuugggccgucccaaaaaacgacaacaacaaaacagcaacaaauucauuaacaauagaaguaccauacauuuguacagaaggagaagaccaaauuaccguuuggggguuccacucugauaacgaaacccaaauggcaaagcucuauggggacucaaagccccagaaguucaccucaucugccaauggagugaccacacauuacguuucacagauugguggcuucccaaaucaaacagaagacggaggacuaccacaaagugguagaauuguuguugauuacauggugcaaaaaucugggaaaacaggaacaauuaccuaucaaagagguauuuuauugccucaaaaaguguggugcgcaaguggcaggagcaagguaauaaaaggauccuugccuuuaauuggagaagcagauugccuccacgaaaaauacgguggauuaaacaaaagcaagccuuacuacacaggggaacaugcaaaggccauaggaaauugcccaauaugggugaaaacacccuugaagcuggccaauggaaccaaauauagaccuccugcaaaacuauuaaaggaaagggguuucuucggagcuauugcugguuucuuagaaggaggaugggaaggaaugauugcagguuggcacggauacacaucccauggggcacauggaguagcgguggcagcagaccuuaaaagcacucaagaggccauaaacaagauaacaaaaaaucucaacucuuugagugagcuggaaguaaagaaucuucaaagacuaagcggugccauggaugaacuccacaacgaaauacuagaacuagacgagaaaguggaugaucucagagcugauacaauaagcucacaaauagaacucgcaguccugcuuuccaaugaaggaauaauaaacagugaagaugagcaucucuuggcgcuugaaagaaagcugaagaaaaugcugggccccucugcuguagagauagggaauggaugcuuugaaaccaaacacaagugcaaccagaccugucucgacagaauagcugcugguaccuuugaugcaggagaauuuucucuccccaccuuugauucacugaauauuacugcugcaucuuuaaaugacgauggauuggauaaucauacuauacugcuuuacuacucaacugcugccuccaguuuggcuguaacauugaugauagcuaucuuuguuguuuauauggucuccagagacaauguuucuugcuccaucugucuauaa

SEQ ID NO: 58463 - RNA, 1758 nt, Artificial Sequence; identical to SEQ ID NO: 58462
  hemagglutinin__InfluenzaB__AHL92299

SEQ ID NO: 58464 - RNA, 1755 nt, Artificial Sequence
  hemagglutinin__InfluenzaB__AHL92310
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaccacaccuucugcgaaagcuucaauacuccacgaaaucagaccuguuacauccgggugcuuuccuauaaugcacgacaggacaaaaaucaggcaacuagccaaucuucucagaggauaugaaaauaucagguuaucaacccaaaacguuaucgaugcagaaaaggcaccaggaggacccuacagacuuggaaccucaggaucuugcccuaacgcuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcggcuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuccacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58465 - RNA, 1755 nt, Artificial Sequence
  hemagglutinin__InfluenzaB__AHL92321
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggaccuuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcaguccugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58466 - RNA, 1755 nt, Artificial Sequence; identical to SEQ ID NO: 57071
  hemagglutinin__InfluenzaB__AHL92332

SEQ ID NO: 58467 - RNA, 1755 nt, Artificial Sequence
  hemagglutinin__InfluenzaB__AHL92354
augaaggcaauaauuguacuacucaugguaguaacauccaaugcagaucgaaucugcacugggauaacaucuucaaacucaccucauguggucaaaacagcuacucaaggggaggucaaugugacuggugugauaccacuaacaacaacaccaacaaaaucuuauuuugcaaaucucaaaggaacaaggaccagagggaaacuaugcccagacugucucaacuguacagaucuggauguggccuugggcagaccaauguguguggggaucacaccuucugcgaaagcuucaauacuccacgaagucagaccuguuacauccgggugcuuuccuauaaugcacgauagaacaaaaaucaggcaacuagccaaucuucucagaggauaugaaaauaucagguuaucaacccaaaacguugucgaugcagaaaaggcaccaggaggacccuacagacuuggaaccucaggaucuugcccuaacgcuaccaguaaaagcggauuuuucgcaacaauggcuugggcugucccaaaggacaacaacaaaaacgcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgguuucccagaucaaacagaagacggaggacuaccacaaagcggcagaauugucguugauuacaugaugcaaaaaccugggaaaacaggaacaauugucuaucaaagagguguuuuguugccucaaaagguguggugcgcgaguggcaggagcaaaguaauaaaaggguccuugccuuuaauuggugaagcagauugccuucaugaaaaauacgguggauuaaacaaaagcaagcccuacuacacaggagaacaugcaaaagcuauaggaaauugcccaauaugggugaaaacaccuuugaagcuugccaauggaaccaaauauagaccuccugcaaaacuauuaaaggaaagggguuucuucggagcuauugcugguuuucuagaaggaggaugggaaggaaugauugcagguuggcacggauacacaucucacggagcacauggaguggcaguugcggcagaccuuaagaguacacaagaagcuauaaacaagauaacaaaaaaucucaacucuuugagugagcuagaaguaaagaaucuucaaagacuaaguggugccauggaugaacuucacaacgaaauacucgagcuggaugagaaaguggaugaucucagagcugacacuauaagcucacaaauagaacuugcaguuuugcuuuccaacgaaggaauaauaaacagugaagacgagcaucuauuggcacuugagagaaaacuaaagaaaaugcugggucccucugcuguggacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggguuggauaaccauacuauacugcucuauuacucaacugcugcuucuaguuuggcuguaacauugaugcuagccauuuuuauuguuuauauggucuccagagacaacguuucaugcuccaucugucuauaa

SEQ ID NO: 58468 - RNA, 1755 nt, Artificial Sequence; identical to SEQ ID NO: 58467
  hemagglutinin__InfluenzaB__AHL92365

SEQ ID NO: 58469 - RNA, 1755 nt, Artificial Sequence
  hemagglutinin__InfluenzaB__AHL92376
augaaggcaauaauuguacuacucaugguaguaacauccaaugcagaucgaaucugcacugggauaacaucuucaaacucaccucauguggucaaaacagcuacucaaggagaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58470 - RNA, 1755 nt, Artificial Sequence
  hemagglutinin__InfluenzaB__AHL92387
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuacuaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58471 - RNA, 1755 nt, Artificial Sequence; identical to SEQ ID NO: 57330
  hemagglutinin__InfluenzaB__AHL92398

SEQ ID NO: 58472 - RNA, 1755 nt, Artificial Sequence; identical to SEQ ID NO: 57330
  hemagglutinin__InfluenzaB__AHL92409

SEQ ID NO: 58473 - RNA, 1755 nt, Artificial Sequence; identical to SEQ ID NO: 57330
  hemagglutinin__InfluenzaB__AHL92420

SEQ ID NO: 58474 - RNA, 1755 nt, Artificial Sequence
  hemagglutinin__InfluenzaB__AHL92431
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucucacggagcacauggaguggcaguggcggcggaccuuaagaguacgcaagaagcuauaaauaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacuaaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58475 - RNA, 1755 nt, Artificial Sequence; identical to SEQ ID NO: 57330
  hemagglutinin__InfluenzaB__AHL92442

SEQ ID NO: 58476 - RNA, 1755 nt, Artificial Sequence; identical to SEQ ID NO: 58470
  hemagglutinin__InfluenzaB__AHL92453

SEQ ID NO: 58477 - RNA, 1755 nt, Artificial Sequence; identical to SEQ ID NO: 57330
  hemagglutinin__InfluenzaB__AHL92464

SEQ ID NO: 58478 - RNA, 1755 nt, Artificial Sequence
  hemagglutinin__InfluenzaB__AHL92475
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccaggccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58479 - RNA, 1755 nt, Artificial Sequence; identical to SEQ ID NO: 57071
  hemagglutinin__InfluenzaB__AHL92486

SEQ ID NO: 58480 - RNA, 1755 nt, Artificial Sequence; identical to SEQ ID NO: 57330
  hemagglutinin__InfluenzaB__AHL92497

SEQ ID NO: 58481 - RNA, 1755 nt, Artificial Sequence; identical to SEQ ID NO: 58470
  hemagglutinin__InfluenzaB__AHL92508

SEQ ID NO: 58482 - RNA, 1755 nt, Artificial Sequence; identical to SEQ ID NO: 58470
  hemagglutinin__InfluenzaB__AHL92519

SEQ ID NO: 58483 - RNA, 1755 nt, Artificial Sequence; identical to SEQ ID NO: 58470
  hemagglutinin__InfluenzaB__AHL92530

SEQ ID NO: 58484 - RNA, 1755 nt, Artificial Sequence; identical to SEQ ID NO: 57071
  hemagglutinin__InfluenzaB__AHL92541

SEQ ID NO: 58485 - RNA, 1752 nt, Artificial Sequence
  hemagglutinin__InfluenzaB__AHL92563
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaaaaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccggaugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58486 - RNA, 1755 nt, Artificial Sequence; identical to SEQ ID NO: 57330
  hemagglutinin__InfluenzaB__AHL92574

SEQ ID NO: 58487 - RNA, 1755 nt, Artificial Sequence
  hemagglutinin__InfluenzaB__AHL92585
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaaugugugugggggccacaccuucggcgaaagcuucaauacuccacgaagucagaccuguuacauccgggugcuuuccuauaaugcacgacagaacaaaaaucaggcaacuacccaaucuucucagaggauaugaaaauaucagguuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaagaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58488 - RNA, 1755 nt, Artificial Sequence; identical to SEQ ID NO: 57330
  hemagglutinin__InfluenzaB__AHL92596

SEQ ID NO: 58489 - RNA, 1755 nt, Artificial Sequence
  hemagglutinin__InfluenzaB__AHL92607
augaaggcaauaauuguacuacucaugguaguaacauccaaugcagaucgaaucugcacuggaauaacaucuucaaacucaccucauguggucaaaacagccacucaaggggaggucaaugugacuggugugauaccacuaacaacaacaccaacaaaaucuuauuuugcaaaucucaaaggaacaaggaccagagggaaacuaugcccagacugucuuaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaaacuauuaaaggaaagggguuucuucggagcuauugcugguuuccuagaaggaggaugggaaggaaugauugcaggcuggcacggauacacaucccacggagcacauggaguggcaguggcggcggaccuuaagaguacgcaagaagcuauaaacaagauaacaaaaaaucucaauucuuugagugagcuagaaguaaagaaucuucaaagacuaaguggugcuauggaugaacuccacaacgaaauacucgagcuggaugagaaaguggaugaucucagagcugacacuauaagcucgcaaauagaacuugcagucuugcuuuccaacgaaggaauaauaaacagugaagaugagcauuuauuggcacuugagagaaaauuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauacuauacugcucuauuacucaacugcugcuucuaguuuggcuguaacauugaugcuagcuauuuuuauuguuuauauggucuccagagacaacguuucaugcuccaucugucuauaa

SEQ ID NO: 58490 - RNA, 1755 nt, Artificial Sequence
  hemagglutinin__InfluenzaB__AHL92629
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccagaaaaaucuuauuuugcaaaucucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagauuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggauuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58491 - RNA, 1755 nt, Artificial Sequence; identical to SEQ ID NO: 57071
  hemagglutinin__InfluenzaB__AHL92640

SEQ ID NO: 58492 - RNA, 1755 nt, Artificial Sequence; identical to SEQ ID NO: 57071
  hemagglutinin__InfluenzaB__AHL92651

SEQ ID NO: 58493 - RNA, 1755 nt, Artificial Sequence
  hemagglutinin__InfluenzaB__AHL92684
augaaggcaauaauuguacuacucaugguaguaacauccaaugcagaucgaaucugcacuggaauaacaucuucaaacucaccucacguggucaaaacagccacucaaggggaggucaaugugacuggugugauaccacuaacaacaacaccaacaaaaucuuauuuugcaaaucucaaaggaacaaggaccagagggaaacuaugcccagacugucucaacugcacagaucuggauguggcuuugggcagaccaauguguguggggaccacaccuucggcgaaagcuucaauacuccacgaagucagaccuguuacauccgggugcuuuccuauaaugcacgacagaacaaaaaucaggcaacuacccaaucuucucagaggauaugaaaauaucaggcuaucaacccaaaacgucaucgaugcggaaaaggcaccaggaggacccuacagacuuggaaccucaggaucuugcccuaacgcuaccaguaagagcggauuuuucgcaacaauggcuugggcugucccaaaggacaacaacaaaaaugcaacgaacccacuaacaguagaaguaccauacauuuguacagaaggggaagaccaaaucacuguuuggggguuccauucagauaacaaaacccaaaugaagaaccucuauggagacucaaauccucaaaaguucaccucaucugcuaauggaguaaccacacacuauguuucucagauuggcagcuucccagaucaaacagaagacggaggacuaccacaaagcggcaggauuguuguugauuacaugaugcaaaaaccugggaaaacaggaacaauugucuaccaaagagguguuuuguugccucaaaagguguggugcgcgaguggcaggagcaaaguaauaaaaggguccuugccuuuaauuggugaagcagauugccuucaugaaaaauacgguggauuaaacaaaagcaagccuuacuacacaggagaacaugcaaaagccauaggaaauugcccaauaugggugaaaacaccuuugaagcuugccaauggaaccaaauauagaccuccugcaaagcuauuaaaggaaagggguuucuucggagcuauugcugguuuccuagaaggaggaugggaaggaaugauugcaggcuggcacggauacacaucucacggagcacauggaguggcaguggcggcggaccuuaagagcacgcaagaagcuauaaacaagauaacaaaaaaucucaauucuuugagugagcuagaaguaaagaaucuucaaagacuaaguggugccauggaugaacuccacaacgaaauacucgagcuggaugagaaaguggaugaucucagagcugacacuauaagcucgcaaauagaacuugcagucuugcuuuccaacgaaggaauaauaaacagugaagaugagcaucuauuggcacuugagagaaaacuaaagaaaaugcugggucccucugcuguagagauaggaaauggaugcuucgaaaccaaacacaagugcaaccagaccugcuuagacaggauagcugcuggcaccuuuaaugcaggagaauuuucucuccccacuuuugauucacugaacauuacugcugcaucuuuaaaugaugauggauuggauaaccauauuauacugcucuauuacucaacugcugcuucuaguuuggcuguaacauugaugcuagcuauuuuuauuguuuauauggucuccagagacaacguuucaugcuccaucugucuauaa

SEQ ID NO: 58494 - RNA, 1755 nt, Artificial Sequence; identical to SEQ ID NO: 57324
  hemagglutinin__InfluenzaB__AHL92695

SEQ ID NO: 58495 - RNA, 1755 nt, Artificial Sequence
  hemagglutinin__InfluenzaB__AHL92706
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuuaggcaggccaauguguguggggaccacaccuucugcuaaggcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauuccuugagugagcuagaaguaaaaaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58496 - RNA, 1755 nt, Artificial Sequence
  hemagglutinin__InfluenzaB__AHL92728
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggaaaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauaaucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58497 - RNA, 1755 nt, Artificial Sequence; identical to SEQ ID NO: 58496
  hemagglutinin__InfluenzaB__AHL92739

SEQ ID NO: 58498 - RNA, 1755 nt, Artificial Sequence; identical to SEQ ID NO: 58496
  hemagglutinin__InfluenzaB__AHL92750

SEQ ID NO: 58499 - RNA, 1755 nt, Artificial Sequence; identical to SEQ ID NO: 58470
  hemagglutinin__InfluenzaB__AHL92761

SEQ ID NO: 58500 - RNA, 1755 nt, Artificial Sequence
  hemagglutinin__InfluenzaB__AHL92772
augaaggcaauaauuguacuacucaugguaguaacauccaaugcagaucgaaucugcacugggauaacaucuucaaacucaccucauguggucaaaacagcuacucaaggggaggucaaugugacuggugugauaccacugacaacaacaccaacaaaaucuuauuuugcaaaucucaaaggaacaaggaccagagggaaacuaugcccggacugucucaacuguacagaucuggauguggccuugggcaggccaaugugcauggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccaaaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58501 - RNA, 1755 nt, Artificial Sequence
  hemagglutinin__InfluenzaB__AHL92794
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccuccgcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58502 - RNA, 1755 nt, Artificial Sequence
  hemagglutinin__InfluenzaB__AHL92805
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaucucaaaggaacaaggaccagagggaaacuaugcccggacugucucaacuguacagaucuggauguggccuugggcaggccaaugugugugggaaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccaaaacguuaucgaugcagaaaaagcaccaggaggacccuacagacuuggaaccucaggaucuugcccuaacgcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggucccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuauuguuuauauggucuccagagacaacguuucaugcuccaucugucuauaa

SEQ ID NO: 58503 - RNA, 1755 nt, Artificial Sequence; identical to SEQ ID NO: 58172
  hemagglutinin__InfluenzaB__AHL92816

SEQ ID NO: 58504 - RNA, 1755 nt, Artificial Sequence
  hemagglutinin__InfluenzaB__AHL92827
augaaggcaauaauuguacuacucaugguaguaacauccaaugcagaucgaaucugcacugggauaacaucuucaaacucaccucauguggucaaaacagcuacucaaggggaggucaaugugacuggcgugauaccacugacaacaacaccaacaaaaucuuauuuugcaaaccucaaaggaacaaggaccagagggaaacuaugcccggacugucucaacuguacagaucuggauguggccuugggcaggccaauguguguggggaccacaccuucugcuaaagcuucaauacuccacgaagucagaccuguuacauccgggugcuuuccuauaaugcacgacagaacaaaaaucaggcaacuacccaaucuucucagaggauaugaaaauaucagguuaucaacccagaacguuaucgaugcagaaaaagcaccaggaggacccuacagacuuggaaccucaggaucuugcccuaaugcuaccaguaaaaucggauuuuucgcaacaauggcuugggcugucccaaaggacaacuacaaaaaugcaacgaacccacuaacaguagaaguaccauacauuuguacagaaggggaagaccaaauuacuguuuggggguuccauucagauaacaaaacccaaaugaagaaccucuauggagacucaaauccucaaaaguucaccucaucugcuaauggaguaaccacacauuauguuucucagauuggcgacuucccagaucaaacagaagacggaggacuaccacaaagcggcagaauuguuguugauuacaugaugcaaaaaccugggaaaacaggaacaauugucuaucaaagagguguuuuguugccucaaaagguguggugcgcgaguggcaggagcaaaguaauaaaagggucauugccuuuaauuggugaagcagauugccuucaugaaaaauacgguggauuaaacaaaagcaagccuuacuacacaggagaacaugcaaaagccauaggaaauugcccaauauggguaaaaacaccuuugaagcuugccaauggaaccaaauauagaccuccugcaaaacuauuaaaggaaagggguuucuucggagcuauugcugguuuccuagaaggaggaugggaaggaaugauugcagguuggcacggauacacaucucacggagcacauggaguggcaguggcggcagaccuuaagaguacacaagaagcuauaaauaagauaacaaaaaaucucaauucuuugagugagcuagaaguaaagaaccuucaaagacuaaguggugccauggaugaacuccacaacgaaauacucgagcuggaugagaaaguggaugaucucagagcugacacuauaagcucacaaauagaacuugcagucuugcuuuccaacgaaggaauaauaaacagugaagacgagcaucuauuggcacuugagagaaaacuaaagaaaaugcugggccccucugcuguagacauaggaaauggaugcuucgaaaccaaacacaaaugcaaccagaccugcuuagacaggauagcugcuggcaccuuuaaugcaggagaauuuucucuccccacuuuugauucauugaacauuacugcugcaucuuuaaaugaugauggauuggauaaccauacuauacugcucuauuacucaacugcugcuucuaguuuggcuguaacauuaaugcuagcuauuuuuguuguuuauauggucuccagagacaacguuucaugcuccaucugucuauaa

SEQ ID NO: 58505 - RNA, 1755 nt, Artificial Sequence; identical to SEQ ID NO: 57330
  hemagglutinin__InfluenzaB__AHL92838

SEQ ID NO: 58506 - RNA, 1755 nt, Artificial Sequence; identical to SEQ ID NO: 58502
  hemagglutinin__InfluenzaB__AHL92849

SEQ ID NO: 58507 - RNA, 1755 nt, Artificial Sequence; identical to SEQ ID NO: 57330
  hemagglutinin__InfluenzaB__AHL92860
